United States Patent
Li et al.

(10) Patent No.: US 11,732,276 B2
(45) Date of Patent: *Aug. 22, 2023

(54) USE OF GENOMIC NW_006882077.1 IN CHO CELL FOR STABLY EXPRESSING A PROTEIN

(71) Applicant: Jiangnan University, Wuxi (CN)

(72) Inventors: Huazhong Li, Wuxi (CN); Yun Chen, Wuxi (CN); Jian Jin, Wuxi (CN); Songtao Zhou, Wuxi (CN); Zuoying Duan, Wuxi (CN); Xiaohai Gong, Wuxi (CN)

(73) Assignee: Jiangnan University, Wuxi (CN)

( * ) Notice: Subject to any disclaimer, the term of this patent is extended or adjusted under 35 U.S.C. 154(b) by 583 days.

This patent is subject to a terminal disclaimer.

(21) Appl. No.: 16/644,955

(22) PCT Filed: Dec. 3, 2018

(86) PCT No.: PCT/CN2018/118888
§ 371 (c)(1),
(2) Date: Mar. 5, 2020

(87) PCT Pub. No.: WO2020/087641
PCT Pub. Date: May 7, 2020

(65) Prior Publication Data
US 2021/0238634 A1    Aug. 5, 2021

(30) Foreign Application Priority Data

Oct. 30, 2018   (CN) .......................... 201811274640.6

(51) Int. Cl.
*C12N 15/90*    (2006.01)
*C12N 5/071*    (2010.01)
*C12N 15/85*    (2006.01)

(52) U.S. Cl.
CPC ......... *C12N 15/907* (2013.01); *C12N 5/0682* (2013.01); *C12N 15/85* (2013.01); *C12N 2510/02* (2013.01); *C12N 2810/10* (2013.01)

(58) Field of Classification Search
CPC .... C12N 15/907; C12N 5/0682; C12N 15/85; C12N 2510/02; C12N 2810/10
See application file for complete search history.

(56) References Cited

FOREIGN PATENT DOCUMENTS

| CN | 107557390 A | 1/2018 |
| CN | 107723276 A | 2/2018 |
| WO | 2018148196 A1 | 8/2018 |

OTHER PUBLICATIONS

Zhou, S et al. CN107557390A machine translation, p. 1-16. 2018. (Year: 2018).*
David L Hacker et al., Recombinant protein production from stable mammalian cell lines and pools, Current Opinion in Structural Biology, 2016, pp. 129-136, 38.
Hong Zhou et al., Strategies to Improve the Stability of Protein Production from High Level Expression Recombinant CHO Cells, Letters in Biotechnology, 2006, pp. 945-949, vol. 17 No. 6.
Jiaxian Wang et al., Application of Crispr/Cas9 Technology in Targeted Gene Integration in CHO cells, Chinese Journal of Pharmaceuticals 2017, pp. 33-36, 48(1).
Jae Seong Lee et al., Site-specific integration in CHO cells mediated by CRISPR/Cas9 and homology-directed DNA repair pathway, Scientific Reports, 2015, pp. 1-11, 5 : 8572.
Jae Seong Lee et al., Accelerated Homology-Directed Targeted Integration of Transgenes in Chinese Hamster Ovary Cells Via CRISPR/Cas9 and Fluorescent Enrichment, Biotechnology and Bioengineering, 2016, pp. 2518-2523, 10.113, vol. 11.
Menglin Zhao et al., Rapid development of stable transgene CHO cell lines by CRISPR/Cas9-mediated site-specific integration into C12orf35, Applied Microbiology and Biotechnology, 2018 pp. 6105-6117, 102.

* cited by examiner

*Primary Examiner* — Paul J Holland
(74) *Attorney, Agent, or Firm* — Bayramoglu Law Offices LLC

(57) ABSTRACT

Use of genomic NW_006882077.1 in CHO cell for stably expressing a protein is disclosed. The certain site in CHO cell genome for stably expressing a protein is positioned at a base of No. 691045 in a CHO cell gene NW_006882077.1; a sequence of 5' NNNNNNNNNNNNNNNNNNNNNGG3' that can be identified by CRISPR/Cas9 technology and positioned in a base range of No. 690980-691090 around the certain site is a target sequence. Various of protein genes are introduced into a fixed site in CHO cell genome, and expressed stably in the present disclosure.

9 Claims, 1 Drawing Sheet
Specification includes a Sequence Listing.

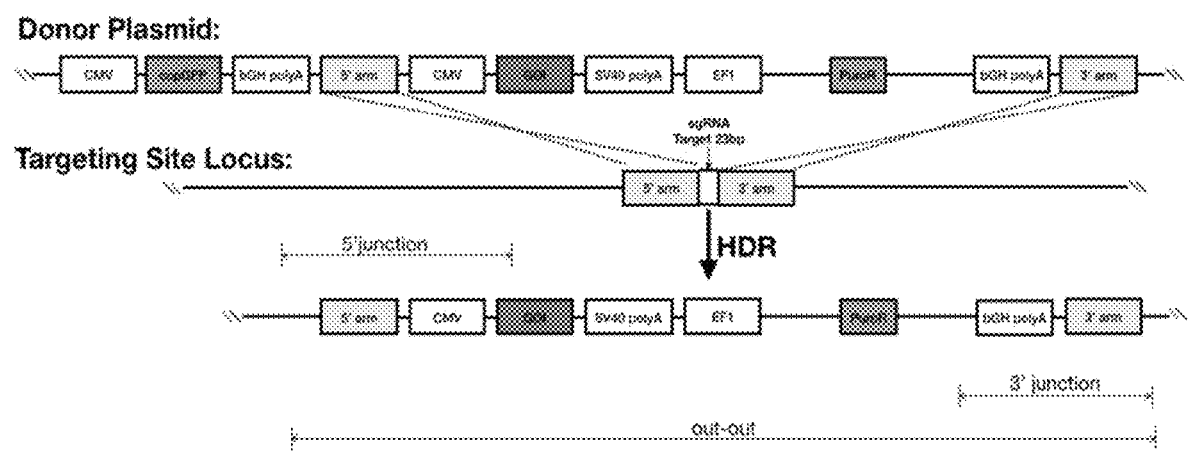

USE OF GENOMIC NW_006882077.1 IN CHO CELL FOR STABLY EXPRESSING A PROTEIN

CROSS REFERENCE TO THE RELATED APPLICATIONS

This application is the national phase entry of International Application No. PCT/CN2018/118888, filed on Dec. 3, 2018, which is based upon and claims priority to Chinese Patent Application No. 2018112746406, filed on Oct. 30, 2018, the entire contents of which are incorporated herein by reference.

REFERENCE TO SEQUENCE LISTING

The instant application contains a Sequence Listing which has been submitted in ASCII format via EFS-Web and is hereby incorporated by reference in its entirety. The ASCII copy is named "GBHY034_ST25-20230303.txt", created on Mar. 3, 2023, and is 2,495,459 bytes in size.

TECHNICAL FIELD

The present disclosure relates to the field of genetic technology, particularly to gene recombination in a CHO cell for stably expressing a protein.

BACKGROUND

Chinese Hamster Ovary (CHO) cell is an important cell line used in biopharmaceuticals. Many different types of CHO cell lines have been developed including a cell line that can be used to expand gene copy numbers. However, by increasing transgene copy number is not correlated well with the increase in express level of the target protein. Also the expression level of most CHO cells is unstable even with increased protein expression. The current mostly used method of constructing stable transfected cells is time-consuming and labor-intensive, mainly due to repetitive monoclonal screening processes. Thus, it is currently expected in the field of cell line construction that a method of obtaining a cell expressed stably and in a high level within a short time, and can ensure that the constructed recombinant cell line has the same quality level as traditional methods to ensure regulatory approval.

A traditional method of constructing an exogenous protein-expressing cell line is to randomly integrate an exogenous gene into the cell genome, which is subjected to screening of a series of high-expressing monoclonal cells, to obtain a cell line with a high expressing of exogenous protein. Due to the diversity of site effect differences, the recombinant cells produced by random integration have different expression levels. It takes a long time and many steps to select high-expressing monoclonal cells. Monoclonal cells obtained through random integration cannot guarantee stably expressing peptides/proteins in cell passages, and monoclonal screening needs to be repeated at each time a recombinant cell is constructed, increasing the cost of research and development of biopharmaceuticals.

The site effect hinders the efficiency of traditional random integration to construct recombinant cell lines. Repetitive high-expression monoclonal screening is time-consuming, labor-intensive and expensive. How to overcome the site effect and to obtain quickly and efficiently stable expressing monoclonal cells by using the site-specific integration technology has been discussed in the art for many years, and there has been no breakthrough progress.

SUMMARY

In view of the above problems in the prior art, the applicant of the present disclosure provides use of NCBI GenBank accession number genomic NW_006882077.1 (SEQ ID NO: 11) in CHO cell for stably expressing a protein. In the present disclosure, different protein genes are introduced into the CHO cell genome at a fixed position and expressed stably. In addition, in the process of achieving the site-specific integration, there is no need to select repeatedly monoclonal cells to obtain cell lines with higher expression, which saves a lot of time.

The technical solution of the present disclosure is as follows.

Use of a certain site in CHO cell genome for stably expressing a protein, wherein the site in CHO genome for stably expressing a protein is positioned at a base of No. 691045 in a CHO cell gene NW_006882077.1;

a sequence of 5' NNNNNNNNNNNNNNNNNNNNNGG3', as shown in SEQ ID NO:10, that can be identified by CRISPR/Cas9 technology and positioned in a base range of No. 690980-691090 around the certain site is a target sequence.

The protein is one having a molecular weight of less than 160 KDa.

The protein is one selected from the group consisting of red fluorescence protein, polypeptide, a functional protein, an antibody, and a fusion protein.

The target sequence is the bases positioned at No. 691068-691090, around the base of No. 691045 in the CHO cell gene NW_006882077.1.

Further, the target sequence is 5'-GATCTAACTTGGCTTGCCTGAGG-3', as shown in SEQ ID NO:1.

The target sequence is 5'-TGCAACTCTCAGATCTAACTTGG-3', as shown in SEQ ID NO:2.

The target sequence is 5'-GAGAGTTGCAGTAACGAAAGTGG-3', as shown in SEQ ID NO:3.

The target sequence is 5'-GAGTTAACTAAAGTGACTGAAGG-3', as shown in SEQ ID NO:4.

The target sequence is 5'-TCAAGAACAGATGCTGAAGAAGG-3', as shown in SEQ ID NO:5.

The target sequence is 5'-GCTGAAGAAGGTAATAGCATTGG-3', as shown in SEQ ID NO:6.

The present disclosure provides a recombinant donor carrier containing the target sequence for expressing the protein.

The recombinant donor carrier is a carrier for CHO cell expression.

The recombinant donor carrier is prepared by inserting a protein gene into a region between the 5'arm and 3'arm of the plasmid, so that the nucleotide sequence is located downstream of the promoter and is regulated by the promoter to obtain a recombinant CHO cell expression plasmid.

The promoter is one selected from the group consisting of CMV (a strong promoter for expression in a mammalian cell derived from human cytomegalovirus), EF-1a (a strong promoter for expression in a mammalian cell derived from human elongation factor 1α), SV40 (a promoter for expression in a mammalian cell derived from simian vacuole virus 40), PGK1 (a promoter for expression in a mammalian cell derived from phosphoglycerate kinase gene), UBC (a promoter for expression in a mammalian cell derived from human ubiquitin C gene), human beta actin (a promoter for expression in a mammalian cell derived from β-actin gene), and CAG (a strong hybrid promoter for expression in a mammalian cell).

Also provided is a recombinant CHO cell line for expressing a protein.

Further provided is a method for expressing a protein by a gene in a CHO cell including (1) transforming a CHO cell with a recombinant donor carrier to obtain a recombinant CHO cell;

(2) culturing the recombinant CHO cell on a plate, and collecting the supernatant to detect the expression level, and adapting an adherent recombinant CHO cell to suspension culture;

(3) culturing the adopted recombinant CHO cell in a shake flask and determining the protein expressing level.

The present disclosure also provides a selection of a stable expression site in a CHO cell genome:

1) constructing a lentivirus with a fluorescent label and calculating its titer; integrating igk-luc gene to a multiple cloning site on pLVX-CMV-MCS-T2A-Zsgreen carrier, followed by performing three plasmid transfection to HEK-293T cell by using plasmids of pSPAX2 and pMD2G, aspirating the supernatant twice at 48 h and 72 h, collecting and then ultra-centrifuging the supernatant to obtain lentivirus;

2) placing the CHO cells on a 6-well plate and culturing the CHO cells overnight, diluting the lentivirus on the following day, infecting the CHO cells at a low MOI (multiplicity of infection) (MOI<1)(number of virus particles corresponding to each cell); sorting the cells with a flow cell sorter after 96 hrs from the infection, and inoculating the cells with the highest fluorescence intensity directly into a 96-well plate; observing the cells with a fluorescent microscope after the cells grow into monoclonal colonies one week later, selecting the brightest colony cells having a normal morphology and growth, and transferring the cells to a 24-well plate for expansion; transferring the cells to a 6-well plate when a confluence of nearly 90% is achieved, and finally transferring to a 10 cm culture dish; and freezing part of the cells and expanding the remaining cells;

3) searching out all gene integration sites of CHO cells in lentivirus with chromosome walking technology by using Lenti-X Integration Site Analysis Kit (Clontech: 631263).

Genomic DNA was digested overnight with three restriction enzymes: ADraI, SspI, and HpaI, by using several cell lines with the highest fluorescence intensity and normal cell morphology and growth rate as material. A reaction system of 100 μL was prepared with 2.5 Kg of genomic DNA and 80U of restriction enzyme, and was digested at 37° C. overnight (16-18 hours).

The digested product was purified and recovered with a DNA recovery kit. A ligation system for test was prepared with 4.8 μL of the digested genomic DNA, 1.9 μL of genome walker adaptor (25 μM) and 0.5 μL of T4 ligase, which is placed at 16° C. for ligation overnight. The ligation system was heated at 70° C. for 5 minutes to inactivate the ligase. 32 μL of TE buffer was added to each system to prepare corresponding library.

Two rounds of nested PCR were performed on the library to amplify the LTR region and adjacent genomic regions. Related steps for PCR reaction can be referred to the instructions of Lenti-X Integration Site Analysis Kit (Clontech: 631263) kit.

Finally, the PCR products were electrophoresed, and the main bands were cut and recovered for sequencing. After obtaining all the lentiviral integration information of each cell line, the relevant information of the CHO cell line with only a single copy of the lentivirus integration was select, and compared with the CHO-K1 genome information on BLAST to find out the integration site with high expression.

The present disclosure has the following advantages:

A site-specific integration method is used in the present application to integrate the target gene into a stable expression region at a specific site. The method can well address the problem of uncertain integration site caused by random integration, and effectively avoid repetitive screening for high-expressing monoclonal cells. Therefore, the method can effectively reduce development time of biopharmaceuticals to build stable expression cell lines, and thus reduce costs.

In the present disclosure, a protein gene is introduced at a fixed site of a CHO cell gene and stably expressed.

BRIEF DESCRIPTION OF THE DRAWINGS

The FIGURE shows a schematic diagram of the present disclosure.

DETAILED DESCRIPTION

The present disclosure is described in detail below with reference to the drawings and embodiments.

The FIGURE is a schematic diagram of a donor plasmid for integration to the site and a simulated schematic diagram of how to integrate to the site by homologous recombination. GOI as a target gene is integrated to a target site via two homologous recombination arms of 5'arm and 3' arm under a puromycin screening concentration of 4 μg/mL. In addition, the sequence upstream of 5'arm as a negative mark of screening can be used to remove monoclonal cells that are randomly integrated, such that recombinant CHO cells that are integrated at a specific site can be finally recovered.

Example 1

Selection of High Expression Site

Zsgreen1 gene was integrated at the base of No. 691045 in NW_006882077.1 gene of a cell. The obtained fluorescence cell was cultured for no less than 50 passages. The expression level was detected with a flow cytometry. The 50th generation of fluorescent cells still had a good green fluorescent protein expression level. The fluorescent signal was stably retained during the passage of the cells.

In addition, this fluorescent cell was also adapted to suspension, and the expression level of the fluorescent protein after adaption was detected again with a flow cytometry. The results show that among the recombinant CHO cells that are suspended over 50 passages, more than 95% maintains the expression level of the green fluorescent protein after suspension. It can be seen that the site is very stable and the fluorescent protein gene will not be lost due to passage of the cells.

Example 2

Selection of a Specific Target Sequence

According to proximity principle, the sequence of 5'CCAATGCTATTACCTTCTTCAGCATCTGTTCTT-GAAGACCTTCAGTCACTTTAGTTAA CTCTTC-CACTTTCGTTACTG-CAACTCTCA-GATCTAACTTGGCTTG 3', as shown in SEQ ID NO:7, was input into CRISRPRater System, and a target sequence with low off-target rate was predict and select. The parameter settings are as follows: 1) the maximum number of mismatched bases of the first 15 base pairs (bps) after NGG is 0; 2) the number of mismatched bases of all 21 bps after NGG is 2.

According to the above operation, the following sequence with a score of 0.87 is selected as the target sequence:

5'-GATCTAACTTGGCTTGCCTGAGG-3', as shown by SEQ ID NO:1; and according to the CRISPRater System, LOW efficacy (score<0.56); MEDIUM efficacy (0.56⇐score⇐0.74); and HIGH efficacy (score>0.74).

According to the CRISPRater System, all target sequences in the range of 690980-691090 near NW_006882077.1 have scores above 0.56, all of which are in the range of moderate or highly effective, and can be used as 5' GG3', as shown by SEQ ID NO:10 target sequence that can be identified by CRISPR/Cas9 technology.

Example 3 Selection of Promoters

The promoter of CMV (a strong promoter for expression in a mammalian cell derived from human cytomegalovirus) is replaced with various promoters including common promoters such as EF-1a (a strong promoter for expression in a mammalian cell derived from human elongation factor 1a), SV40 (a promoter for expression in a mammalian cell derived from simian vacuole virus 40), PGK1 (a promoter for expression in a mammalian cell derived from phosphoglycerate kinase gene), UBC (a promoter for expression in a mammalian cell derived from human ubiquitin C gene), human beta actin (a promoter for expression in a mammalian cell derived from β-actin gene), and CAG (a strong hybrid promoter for expression in a mammalian cell). It is determined by testing that the above promoters can regulate the downstream red fluorescence proteingene sequence and express the corresponding red fluorescence protein.

Example 4

The red fluorescence protein (DsRed, 26 KDa) is integrated at a specific site. For homologous recombination mediated by CRISPR/Cas9 later, sgRNA and donor plasmid were required to be constructed as follows.

1. First, the following sequence was synthesized for construction of SgRNA:

sgRNA-1fwd 5' TTTG-GATCTAACTTGGCTTGCCTGGT 3', as shown in SEQ ID NO:8; and sgRNA-1rev 5' TAAAACCAGGCAAGCCAAGTTA-GATC 3' as shown in SEQ ID NO:9.

1) The plasmid of PSK-u6-gRNA was digested with BBsI enzyme, and the resulted carriers were recovered;

2) synthetic fragments were annealed into double strands with sticky ends:

| sgRNA-1fwd (100 μM) | 4 μL |
| sgRNA-1rev (100 μM) | 4 μL |
| 10 × NEB buffer2 | 2 μL |
| H₂O | 10 μL |
| | 20 μL | by treated in a water bath at 95° C. for 5 min, and then naturally cooled to room temperature;

3) the fragments were joint and recombinant plasmids were constructed

| recycled linear carriers | 50 ng |
| annealed segments | 1 μL |
| 10 × T4 ligase buffer | 1 μL |
| T4 ligase | 1 μL |
| H₂O | |
| | to 10 μL ; |

4) joining at room temperature for more than 1 h, or at 4° C. overnight and conversion; and 5) cloning cells were selected and subjected to PCR identification, and the primer used for identification is M13—Synthetic primer R; those showing bands were identified as positive clones.

2. Construction of donor plasmid

The donor plasmid is described in the FIGURE in details: segments expect for GOI were synthesized; the sequence of 600 bps upstream and downstream of the target sequence is the sequence information of the left and right homology arms of the donor plasmid. The GOI is obtained by integrating HSA onto the donor plasmid with the existing C115 kit from Vazyme Biotech.

3. Cas9 (donated by Dr. Helene F Kildegaard from Technical University of Denmark), SgRNA and donor plasmid with a molar ratio of 1:1:1 were co-transfected into CHO cells cultured at 37° C. with 5% $CO_2$, and transfection reagent is Lipofectamine 3000 (Thermo Fisher Scientific). The method of transfection can be referred to instructions from the supplier. 4 μg/mL puromycin was then added into the resulted cells for screening for 10 days. MoFloXDP FACS machine (Beckman Coulter) was used to monoclonal cell sorting. Cells having red fluorescence but without green fluorescence are selected and inoculated into a 96-well plate.

4. After 2 weeks of growth, part of the cells was taken for identification with 5' junction PCR, 3'Junction PCR and out-out PCR, and keep positive cells.

Example 5

The glucagon-like peptide-1-human serum albumin fusion protein gene (NGGH, 75 KDa) was integrate at a specific site. In order to construct CRISPR/Cas9-mediated homologous recombination at a later stage, sgRNA and Donor Plasmid need to be constructed as below.

1. SgRNA was constructed as in example 4.

2. Construction of donor plasmid

The donor plasmid is described in the FIGURE in details: segments expect for GOI were synthesized; the sequence of 600 bps upstream and downstream of the target sequence is the sequence information of the left and right homology arms of the donor plasmid. The GOI is obtained by integrating HSA onto the donor plasmid with the existing C115 kit from Vazyme Biotech.

3. Cas9 (donated by Dr. Helene F Kildegaard from Technical University of Denmark), SgRNA and donor plasmid with a molar ratio of 1:1:1 were co-transfected into CHO cells cultured at 37° C. with 5% $CO_2$, and transfection reagent is Lipofectamine 3000 (Thermo Fisher Scientific). The method of transfection can be referred to instructions from the supplier. 4 μg/mL puromycin was then added into the resulted cells for screening for 10 days. MoFloXDP FACS machine (Beckman Coulter) was used to monoclonal cell sorting. Cells without any fluorescence are selected and inoculated into a 96-well plate.

4. After 2 weeks of growth, part of the cells was taken for identification with 5' junction PCR, 3'Junction PCR and out-out PCR, and keep positive cells.

Example 6

The antibody gene (Avastin, 160 KDa) was integrated at a specific site. In order to construct CRISPR/Cas9-mediated homologous recombination at a later stage, sgRNA and Donor Plasmid need to be constructed as below.
1. SgRNA was constructed as in example 4.
2. Construction of donor plasmid
The donor plasmid is described in the FIGURE in details: segments expect for GOI were synthesized; the sequence of 600 bps upstream and downstream of the target sequence is the sequence information of the left and right homology arms of the donor plasmid. The GOI is obtained by integrating Avastin onto the donor plasmid with the existing C115 kit from Vazyme Biotech.
3. Cas9 (donated by Dr. Helene F Kildegaard from Technical University of Denmark), SgRNA and donor plasmid with a molar ratio of 1:1:1 were co-transfected into CHO cells cultured at 37° C. with 5% $CO_2$, and transfection reagent is Lipofectamine 3000 (Thermo Fisher Scientific). The method of transfection can be referred to instructions from the supplier. 4 μg/mL puromycin was then added into the resulted cells for screening for 10 days. MoFloXDP FACS machine (Beckman Coulter) was used to monoclonal cell sorting. Cells without any fluorescence are selected and inoculated into a 96-well plate.
4. After 2 weeks of growth, part of the cells was taken for identification with 5' junction PCR, 3'Junction PCR and out-out PCR, and keep positive cells.

Example 7

The human serum albumin gene (HSA, 68 KDa) is integrated at a specific site. For homologous recombination mediated by CRISPR/Cas9 later, sgRNA and donor plasmid were required to be constructed as follows.
1. SgRNA was constructed as in example 4.
2. Construction of donor plasmid
The donor plasmid is described in the FIGURE in details: segments expect for GOI were synthesized; the sequence of 600 bps upstream and downstream of the target sequence is the sequence information of the left and right homology arms of the donor plasmid. The GOI is obtained by integrating Avastin onto the donor plasmid with the existing C115 kit from Vazyme Biotech.
3. Cas9 (donated by Dr. Helene F Kildegaard from Technical University of Denmark), SgRNA and donor plasmid with a molar ratio of 1:1:1 were co-transfected into CHO cells cultured at 37° C. with 5% $CO_2$, and transfection reagent is Lipofectamine 3000 (Thermo Fisher Scientific). The method of transfection can be referred to instructions from the supplier. 4 μg/mL puromycin was then added into the resulted cells for screening for 10 days. MoFloXDP FACS machine (Beckman Coulter) was used to monoclonal cell sorting. Cells without any fluorescence are selected and inoculated into a 96-well plate.
4. After 2 weeks of growth, part of the cells was taken for identification with 5' junction PCR, 3'Junction PCR and out-out PCR, and keep positive cells.

TESTING EXAMPLES

The four cell lines prepared in Examples 4-7 were tested by ELISA to observe whether the protein of interest was expressed and whether it was stable long-term expression.
Detection method: all four tests were performed by ELISA method. All selected positive cells were cultured in a 6-well plate and tested for long-term stably expressing the target protein with kits of Human Albumin ELISA Kit (RK00157) and Human IgG(Total) ELISA Kit(RK00393).
The cell line expression of the red fluorescence protein prepared in Example 4 was detected again with a flow cytometry, expression of red fluorescence was observed, and all the cells within 50 generations can stably express red fluorescent protein.
Detection method: cells at different passages were collected and detected directly with a flow cytometry, expression of red fluorescence was observed, and it was detected that more than 95% of the recombinant CHO cells at different passages expressed red fluorescence protein.
Good results were obtained for the above test in which the 5'-GATCTAACTTGGCTTGCCTGAGG-3', as shown by SEQ ID NO. 1, sequence is selected. Therefore, it shows that the target sequences in claims 5-9 can successfully construct a stable expression cell line by site-specific integration, and the protein of interest can be stably expressed for all cell lines.

SEQUENCE LISTING (11 sequences)

SEQ ID NO: 1 - DNA, 23 bp, Cricetulus griseus
gatctaacttggcttgcctgagg

SEQ ID NO: 2 - DNA, 23 bp, Cricetulus griseus
tgcaactctcagatctaacttgg

SEQ ID NO: 3 - DNA, 23 bp, Cricetulus griseus
gagagttgcagtaacgaaagtgg

SEQ ID NO: 4 - DNA, 23 bp, Cricetulus griseus
gagttaactaaagtgactgaagg

SEQ ID NO: 5 - DNA, 23 bp, Cricetulus griseus
tcaagaacagatgctgaagaagg

SEQ ID NO: 6 - DNA, 23 bp, Cricetulus griseus
gctgaagaaggtaatagcattgg

SEQ ID NO: 7 - DNA, 103 bp, Artificial Sequence
  Synthetic DNA
ccaatgctattaccttcttcagcatctgttcttgaagaccttcagtcactttagttaactcttccactttcgttactgcaactctcagatctaacttggcttg

SEQ ID NO: 8 - DNA, 26 bp, Artificial Sequence
  Synthetic DNA
tttggatctaacttggcttgcctggt

SEQ ID NO: 9 - DNA, 26 bp, Artificial Sequence
  Synthetic DNA
taaaaccaggcaagccaagttagatc

SEQ ID NO: 10 - DNA, 23 bp, Cricetulus griseus
  misc_feature (1)..(21): n is a, c, g, or t
nnnnnnnnnnnnnnnnnnnnngg

SEQ ID NO: 11 - DNA, 1908540 bp, Cricetulus griseus
  misc_feature (21637)..(21694): n is a, c, g, or t
  misc_feature (34952)..(35161): n is a, c, g, or t
  misc_feature (39060)..(39486): n is a, c, g, or t
  misc_feature (45788)..(45815): n is a, c, g, or t
  misc_feature (69261)..(69428): n is a, c, g, or t
  misc_feature (77043)..(78288): n is a, c, g, or t
  misc_feature (80258)..(80285): n is a, c, g, or t
  misc_feature (84592)..(84704): n is a, c, g, or t
  misc_feature (97116)..(97167): n is a, c, g, or t
  misc_feature (112673)..(112688): n is a, c, g, or t
  misc_feature (150099)..(150124): n is a, c, g, or t
  misc_feature (157028)..(157152): n is a, c, g, or t
  misc_feature (162743)..(162945): n is a, c, g, or t
  misc_feature (187893)..(188973): n is a, c, g, or t
  misc_feature (202670)..(202726): n is a, c, g, or t
  misc_feature (259096)..(259119): n is a, c, g, or t
  misc_feature (286038)..(286048): n is a, c, g, or t
  misc_feature (350864)..(350997): n is a, c, g, or t
  misc_feature (356338)..(356399): n is a, c, g, or t
  misc_feature (359854)..(360034): n is a, c, g, or t
  misc_feature (362781)..(362827): n is a, c, g, or t
  misc_feature (363644)..(363661): n is a, c, g, or t
  misc_feature (372335)..(372346): n is a, c, g, or t
  misc_feature (401329)..(401414): n is a, c, g, or t
  misc_feature (413702)..(413719): n is a, c, g, or t
  misc_feature (419643)..(419659): n is a, c, g, or t
  misc_feature (439515)..(440108): n is a, c, g, or t
  misc_feature (440425)..(440434): n is a, c, g, or t
  misc_feature (482336)..(482398): n is a, c, g, or t
  misc_feature (488860)..(488885): n is a, c, g, or t
  misc_feature (507787)..(507796): n is a, c, g, or t
  misc_feature (530070)..(530083): n is a, c, g, or t
  misc_feature (531425)..(531798): n is a, c, g, or t
  misc_feature (549828)..(549837): n is a, c, g, or t
  misc_feature (552812)..(553719): n is a, c, g, or t
  misc_feature (606522)..(606615): n is a, c, g, or t
  misc_feature (607352)..(607582): n is a, c, g, or t
  misc_feature (608702)..(608923): n is a, c, g, or t
  misc_feature (610010)..(615553): n is a, c, g, or t
  misc_feature (616272)..(617239): n is a, c, g, or t
  misc_feature (618845)..(619108): n is a, c, g, or t
  misc_feature (622568)..(622588): n is a, c, g, or t
  misc_feature (626937)..(626947): n is a, c, g, or t
  misc_feature (630053)..(630280): n is a, c, g, or t
  misc_feature (638453)..(638525): n is a, c, g, or t
  misc_feature (641077)..(641097): n is a, c, g, or t
  misc_feature (656378)..(656458): n is a, c, g, or t
  misc_feature (717652)..(717739): n is a, c, g, or t
  misc_feature (737439)..(737448): n is a, c, g, or t
  misc_feature (786809)..(791374): n is a, c, g, or t
  misc_feature (803590)..(803835): n is a, c, g, or t
  misc_feature (805986)..(806013): n is a, c, g, or t
  misc_feature (815119)..(815128): n is a, c, g, or t
  misc_feature (815472)..(815536): n is a, c, g, or t
  misc_feature (835818)..(836060): n is a, c, g, or t
  misc_feature (853577)..(853671): n is a, c, g, or t
  misc_feature (854005)..(854100): n is a, c, g, or t
  misc_feature (854574)..(854958): n is a, c, g, or t
  misc_feature (856788)..(857570): n is a, c, g, or t
  misc_feature (870361)..(870790): n is a, c, g, or t
  misc_feature (871280)..(871289): n is a, c, g, or t
  misc_feature (871562)..(871660): n is a, c, g, or t
  misc_feature (871944)..(872775): n is a, c, g, or t
  misc_feature (873157)..(873227): n is a, c, g, or t
  misc_feature (884456)..(884485): n is a, c, g, or t
  misc_feature (886316)..(886487): n is a, c, g, or t
  misc_feature (886851)..(887397): n is a, c, g, or t
  misc_feature (902256)..(903667): n is a, c, g, or t
  misc_feature (906094)..(906104): n is a, c, g, or t
  misc_feature (909393)..(909425): n is a, c, g, or t
  misc_feature (929850)..(929931): n is a, c, g, or t
  misc_feature (938156)..(943834): n is a, c, g, or t
  misc_feature (944836)..(945486): n is a, c, g, or t
  misc_feature (985490)..(985610): n is a, c, g, or t
  misc_feature (988020)..(988046): n is a, c, g, or t
  misc_feature (1029516)..(1029541): n is a, c, g, or t
  misc_feature (1051709)..(1053237): n is a, c, g, or t
  misc_feature (1062400)..(1067798): n is a, c, g, or t
  misc_feature (1087470)..(1087494): n is a, c, g, or t
  misc_feature (1088050)..(1088070): n is a, c, g, or t
  misc_feature (1092376)..(1092506): n is a, c, g, or t
  misc_feature (1112639)..(1112680): n is a, c, g, or t
  misc_feature (1126453)..(1126602): n is a, c, g, or t
  misc_feature (1126922)..(1128642): n is a, c, g, or t
  misc_feature (1152928)..(1152967): n is a, c, g, or t
  misc_feature (1174965)..(1175022): n is a, c, g, or t
  misc_feature (1201768)..(1201801): n is a, c, g, or t
  misc_feature (1205817)..(1206364): n is a, c, g, or t
  misc_feature (1210307)..(1210476): n is a, c, g, or t
  misc_feature (1219578)..(1219744): n is a, c, g, or t
  misc_feature (1244026)..(1244040): n is a, c, g, or t
  misc_feature (1252778)..(1252923): n is a, c, g, or t
  misc_feature (1266679)..(1266826): n is a, c, g, or t
  misc_feature (1289944)..(1290025): n is a, c, g, or t
  misc_feature (1293524)..(1293575): n is a, c, g, or t
  misc_feature (1295944)..(1295978): n is a, c, g, or t
  misc_feature (1307398)..(1307444): n is a, c, g, or t
  misc_feature (1308736)..(1308745): n is a, c, g, or t
  misc_feature (1312343)..(1312445): n is a, c, g, or t
  misc_feature (1339436)..(1339445): n is a, c, g, or t
  misc_feature (1345156)..(1345221): n is a, c, g, or t
  misc_feature (1375065)..(1375128): n is a, c, g, or t
  misc_feature (1375480)..(1375598): n is a, c, g, or t
  misc_feature (1380122)..(1380170): n is a, c, g, or t
  misc_feature (1392573)..(1392650): n is a, c, g, or t
  misc_feature (1396646)..(1397020): n is a, c, g, or t
  misc_feature (1423752)..(1425871): n is a, c, g, or t
  misc_feature (1438241)..(1438314): n is a, c, g, or t
  misc_feature (1440887)..(1440965): n is a, c, g, or t
  misc_feature (1442150)..(1442242): n is a, c, g, or t
  misc_feature (1455389)..(1455414): n is a, c, g, or t
  misc_feature (1462643)..(1463956): n is a, c, g, or t
  misc_feature (1486260)..(1486590): n is a, c, g, or t
  misc_feature (1488562)..(1488724): n is a, c, g, or t
  misc_feature (1489395)..(1489551): n is a, c, g, or t
  misc_feature (1490121)..(1490328): n is a, c, g, or t
  misc_feature (1490656)..(1502815): n is a, c, g, or t
  misc_feature (1503925)..(1504186): n is a, c, g, or t
  misc_feature (1534614)..(1534686): n is a, c, g, or t
  misc_feature (1545666)..(1545730): n is a, c, g, or t
  misc_feature (1561226)..(1561235): n is a, c, g, or t
  misc_feature (1588023)..(1588053): n is a, c, g, or t
  misc_feature (1594047)..(1594142): n is a, c, g, or t
  misc_feature (1601322)..(1601704): n is a, c, g, or t
  misc_feature (1603148)..(1603360): n is a, c, g, or t
  misc_feature (1615079)..(1615552): n is a, c, g, or t
  misc_feature (1617344)..(1617512): n is a, c, g, or t
  misc_feature (1656192)..(1656239): n is a, c, g, or t
  misc_feature (1676793)..(1677128): n is a, c, g, or t
  misc_feature (1677466)..(1678736): n is a, c, g, or t
  misc_feature (1688424)..(1688504): n is a, c, g, or t
  misc_feature (1708182)..(1708378): n is a, c, g, or t
  misc_feature (1734758)..(1734828): n is a, c, g, or t
  misc_feature (1746237)..(1746281): n is a, c, g, or t
  misc_feature (1765384)..(1765429): n is a, c, g, or t
  misc_feature (1782416)..(1782441): n is a, c, g, or t
  misc_feature (1793175)..(1793206): n is a, c, g, or t
  misc_feature (1820097)..(1820730): n is a, c, g, or t
  misc_feature (1825897)..(1825946): n is a, c, g, or t
  misc_feature (1856466)..(1856475): n is a, c, g, or t
  misc_feature (1861002)..(1863832): n is a, c, g, or t
  misc_feature (1886270)..(1886323): n is a, c, g, or t
  misc_feature (1907019)..(1907066): n is a, c, g, or t
catcctgctctcctctattcttcccccaactcaacctttctgctcctcttatttcctcctctcccctcatcttctcctctcattctgccagctccctctcccctacccttaatctcctagtttggtcaggagatcctggcccttcctattctccaggatactgcagctattttttttttgattagtatttccctgctgtaagaagggactctgagagcccatcccccatgaagggatgctctcttggcctggatacatggggagggcctaggcctggcccaggatgacttggtagactttggggagcccctgtggagagccctaccctccctgaggagtggagggggggatgtagtgggggattagggaaaagagttggggggaggggagggagagggagagggagaagggattgacatgtgaagcaagcttgttcctaatttgaaataaaaataaataaaaaaataaaaatatcttaaggaaaaaaaatataccatggctgcttatatccgtgggatgctacctgtatcagaagagaaacagtggagagatgaatggacagtaggagaggaggggtactggggtgaggggaggcatggaacaaaacaaaaagtccaagcccagtgtgactggctgttctagttcagtccgaggtcagcatattctgacacatactagttggtcataaccttccattagtaggactaaagctttttcacgccacagaggcaaagctgagctgttttaacagaggtcttctgacctaaaaagccaaaaatatttacactgtagcatttgctgaacttggctttagtgacacctttattgatttaaagacaaactgacaaacatgaaacctttgaagtctgcctcccatgaatatggtgttgctgttgtacaaggcagctcctatggcaacagcaagcagtgggaagggatcacattagccttactttgattactttcatgttgtagaaaggtaggctcagtggtccttaaatttagcaagcatttggttattcactgggaaactagttaaaatggggctccacattgagttcctggttcagtaagttatagatggagtccaggaatgcacatcactaacaagatcccatcttggggttctggttaggaccacttttgctagctactatttagctttcgaaatattattccttcataaactttagcaaaatctggatggatggtagatgttttgtaatgtcttccgaagagcagatggcctgatttgtttttacagcccttttgaactatagtttacatatcattaaaatttaaccacttcgggctagagacatagttcagaggttaagcacttgctgctcttctagaggtcctaagttctattcctagtaaccacatggtggctcacaacttctatagtgggatctgatgtcctcttctgacttaaagttgtacatgcagaaggagcactcatatacataaaataaataaatctttaaaaaattaactatgttaaatttgaatttcagtaaatgctgtagttgcacatccacaacccctccagtgtacaacaatgccactgtattgaaagctccctcttactgttaatctattctgcttgttctctatttatatatgcatatttaaaattatttaactattttgtctgtatgtgtgtttgatctgaatgtatgcatcacataggtgcttgctgcccatggaggccagaattgggtgccagatcttctgggactggggttacagatagttgcaaactgccaatgtaggtactaggaattgaacctggatcctttaggagtagccagtattcttaaccactgagcaatccctccagtcattatatatgcatagtttaatagtattttaatgcctgctataaacattttatttgaaatgaactattgataattttatgtcagtattataaataataggctatacaaatttgaaaaaatgtttctttgagataaaaagacatagatcttagtcttcataagatttctatatttacttttattggcatatcaaattaatattattcctagagtcagttgaaaaatgaaataagaagactttacttttgttgggcagttgagatgactaatgggtaaaagtgcttgctgccaagcctgatgacctgagttcagtcccatgtgatgaaaaaagagaagtggtcctctgacctcggtaccctcatactcactacacagaagtgcataaatgtaattaaaaggcctttatcatttggtctttgaaatattcagatatagatgaaatgtaggagatagcttaaaggattctgtgtgccagtctgacctgatttcaatcaggttggtagtttggcattctttctttatcttgactggccttcaccatctatttgtttctggtacttcatactcagtcttgaaattgtgttgtttttccagaaatatttcttcatatgttacattatgctaataaaactaaattttgtaggaaagtaaatgacaaacccttgtatattgtgattcattttgtcaattttcaaaatattaagttggcatcccagcaacctttgagtgaatgtgactgagtcttcatgtttcattgtggactcatgaaattcatgtcctccttccttgtaacttgcttcagccgttgtttagttgtcatactgctgatagttgattggatttctaaagtttgctcctgccctttgacctttgttgttaacatttaaatatgtcttcattcccttctatatacgtttttaataatttagtatgtccaagacttatgtatacagtatttcagtcattatttcctcgggcaaacccagctgatcagtgagaatcactcagaggtcataacccagtgctagggagcttatttatttatcccaggaagttgttgatcctagaagttttgtatttctttcaccttggtgcctgatttgacattgttctagtatatactcagtcttagttcaagattgtgtgatattttggcatatgtaaaataacataaactcaactgaattaagtttagcattccttctcattccttctcactggtacttagtgagactggctgctgttttcatgggtcttatgagatggcagagaagagtaaacgttaatgggctaaactgaaactgtgactcagttttctaatgatatgacaacatatttgagaaacttacaagaaggataattttattttggcttagagttttaataattcagtccagggtcacttggccctgttgcctttggacttgtggtgagagcttatgaccaaaggggcctttccacctctttggtggtggagtgtgatgcccagagagaaagaggagggacagaggcacacctctatgtgacctgactctccactaagctctacctctgcagtggtttccaccatttccaacagtgcccatctgagtatgtagttgtttacagttgggcttctgggaggtattccagatccaagctatagcagaagcaacacctggatgaagtgcagagggacacagaaagtattcactctgctggcagggggtgctcaagcagtgtctcacacacccagcatttgtgctgggcattaaaagaaacagccaactggttgtacacaagatgaagaatagtactttcagagagaaggaaaaattatgtatcaaggaggcaggacagctgtttgggaaaccataattgaagtggagaaagggaatagatggagcaaatcaggaaagatgagcttttgcactgtagggttctgagtgcaggcgggtctcatgggctcttcagaacaactggtgaacatgagagaaatcttaagaggaagggcagcatatgggtaagttcagttttgacttgacagacttggagatatatgcagatggtaagtacttggtattatttgtggaatgaaagaagaaacaggtgtgaatcacagggaaccgaaatagaacctgcatgttagccactggtacttggcccatcttctggctcactgtcttaccataagattttcatggaaatagctcaaagcaaatagctcagtagaaaaatagccaaagcatagttagtggtaagctcacagaaggggaaatctgaaaggttaagtaggtctgtgttaacatgttcaaggtcactgtaactatccaggatatgcaaatagcattctgatcctgtgatggaaaagtgcttaagtctgaagaaaaactggttttgacttggatgttaattcacagtgttagctggtgagccattgtggagagtggtgaatggtcagccttgagaaagtcagaagacctactttgatgacatttccattcatataaatcctggaaaagggtacaccagtacaagagacatgttcatcttacagaatgaaacaaagtatgatgtcctatgtataaagtcaaataaggaaaatagtatcattgtatatatgtagtaacagattaaaatactgagttttagagcttggttatctctaagaggggtaagcaggaaggaaattgaattgtaagcctattatttatgcatttgtgcatgtgtctggatgcatactccccacagcatatgtctggatgtgagaggacaacttgcagttatctgtcctctctctgcaccatatgtgttctgcagtagaacttgggtcatcaaccttgatagaaggttcattgacatgcaaaccaacttgcctgcttgcaatgttgtataagtagataacagttaccaagtatacttggtaagatatttgaaatgtttcaatgaaaaaatcttgtgcctatacaatttcagacttgtctttgctctcaaagtaaaatatttttctagcatctaaacaagttaaagagctactatgcagatttgactgataaatgagcttagaagctatttgatctttcagaaatgacttcagcaacagagactcacacaatgccctctgtagttcctgcatctcccaggattcatcctgcatggactcccaaagcatgtcaaatgccttggttgcaagttcctaacagaacactgagattttatcctgttgtcaaagaaccaagagccattgatgtaaaggtaaaaatgaccaggaatatgaggtctgcattggatatactcttacagtgcaagagaaggtttcttatcatgtgtatctctatattgtaacaattcactttaaaatggtatttactgtagtgatgttttctcaggctaagaagtaccttcttttaaagagtcatgtgataaaagacaattacagtgtagtgagttattctgtgttttcctttagccttatgctcaaaccaagacagagtccttgctaagctttgcaacttgtgtgtaagatgtttgggttttgtgacttcatgtgatttcacaatgtgccctctgcagtgtgaaatgtgtaagttggtttgcagtcagagggttttaatttccttgtgaagttcatactaccaaaagaaattgcaatgtttgacttctttttctttagagtccacgaaagaggaagacgagtcacagcacaaccccccctctagagtgtcacgttgggtgggtgatggattccagggaccatgggccaagaccaccctctgtcaggtacctggttgtcagccactgtcttatgctcaattcaagctatttggaaggatttgaaaattaatatatagagaattataaaacagtgagcaatcacagagcagggaagaagcagagctctgtaggaagcacttggaggagagacttcaagatggctctccagggggtgcacagagagaagacttcaatgtcacagcttgttttcatttcagttcttctcacaaatggggattgttagatttgtaaatggtgtgagtgctggaaagtttccttagtaggagcctagattcttcttaatagtaagtaggttcctgggaggtgctaagaaaatttttgtgttaaacagtcttctcaaactatattaaaaatatagaaacagaatatttttaattttgttttcttctttggaagaaacaatttagataattagcagtatatgtatatatttttcttttagttttaactttaagaagaccattatttatctcaaaataggtgaaaatataagccattaccgtgttttctatttaaaacctattcatgtgcccctgagatggctcactgggaaaaggttgctgccatgaaatctgacaactgtagtttagcccccagaacttatgtggtggaaggacaatccctctaatatcatggcatgtgtgtaggtgagcctacacacacacagttaagtataaaagaatcaaagaagtataaaagaatcaaagtctatttcatatttgtagtagatattttcagaattagtgtctgatcattttttctgtttcacactaaattctactgagccatttggtgggccccagaaagattaattttatgaaaacaagtgctagggatttcatcttgaattcgaaatcctgaagcttacttttttgatacctatttggaatgcttttacactgctctcattaaataattgtctttaacagataaaatatgtgtgctgttcaacacactgcttttgaagggttttaatccttgagtgggttgttttgtttgtttattttgtgtgtgtgtgtgtgtgtgtgtgtgtgtgtgtgtgtgtgtgtgtgtgtttgttgctttgttttagcttgtttagagatcagtagggaatggtcagtgacatttagtttaggtagaatgtggttttttgtttgttttgttttgtgttttgagacagggattctctgtgtagcttcctgtcctggcactttgtctttaaagcaggttggcctcaaactcacagagatctgcctgcctctgcctcctgagcactgggattaaagatgtgcaccatcaccacccggcatatttttcttgctaataataaacattcataacttgtctattccctttcctaccccacactttgtcacaaatatggatggtgatgatgaatttaacatctgtccactcttaaatgcaggttactaccagtgttcccactaggtatacttccttgtgtcattatctcctgttgaagctgctctgtcgaatactcacatagctgtttatttgtcatattttcctgtcttttgaaacagtatcactttatgtagtcaagattgttgttttgttttttgtctcactatgtgactcaggctgtcctctaacctcagcctccatatgtgagaggttacagttatgaactacaaaacctgactttgtcagattctccatggcatttagagtcacacacgtacaaaaacatacatttgcatacacataatatttatcctgttctgtttctctgatagtggtggtttgatatattattcagttaggaaaaattcctactgtatattttttttaaatgatgagtttctgtgtatcatgtatatttaggagcccatgtagaccagcagatggcttggtttacctgaaacaacaggtagttgtgagccaccatgtgggtactgggaactgaacctgtgtcctctgcaagagcagtaaatgatgttaacctctgagccatctctccagccccttttctcctcttttgcttttattttgtattcacaatatacatatgtcatagcatttatgtctcagtgctcttgtatctctgatgtttaacttacttccctgctctttctcattgtagtcactttgactacttttgatctatgtttaaacatgcatactattttctcctcagcaagttttctgtttacatatggcgctcactttttacattgggtagtggtggtggtgatggtggtggtggtggtggtggtggtggggggtgtgtgtgtgtgtgtgtgtgtgtgtgtgtgtgtgtgtgtgtgtgtaactgggtcttactatgtaacccaggctagcctagaactcactatgtagaccaggcaggcctcaaactcagatcaccctacccctgtctcccaagagctgatgataaaggtgtgtgttcccacctggcaacagatctttaatatttaatgataattactttaaagttcatttcatgatcatatcaatggtgaccctgagcttggctctggctgtagctattgcattaccattaggtccttaactttgaccaaatacaagatagttactgctgacttttgtttgtttttgcttttaatatccatctctttgctgttttttgtttgtttgtttgtttttaagataaggtctttcttacataactcaggctggcctcaaatccaatatgtatctgagaatgaccgaccttgagcttctgacttcatgcctgtacttcctgtgtgctgggattgcaggtgtgtgctagagactgaacccagaacccggtgcactcatgctaggcaaacatatcaatggagttccagtcccagcccctctcaccattccgtttgcccacccacatccttactgaggtggtggctgcatatgatcaaaatacattgtatggaattctcaaagtgttaatgaaaatatatactacattttaactagaaaaagaagacaaagctaaaccaaaaagaaatagtagagcagagcaaagaatagcaacagaattttaaaaaatagagaaaatcaagaactgaacattgactctttaaagagaccaacaaaactgacaaaattctaaactggccaagatataaatggaaatacacaaaataaaaattagacattagggccaggtggcacatgcctttaatcccagcactccggaggcagaggcaggtggatctctgtgagttcgagaccagcctggtctacaagagctagttctagggcagcctccaaagccacagagaaaccctgtctcgaaaaaccaaaaaaaaaattaaataaataaataaataaatttagacattaggagctcagaagatggatgagtgggtaaaagcacttgctgcacgcacatgcatgagggccagcatttgagcccccagtgcccacatgaaaagctagatatggctgtatttgtttaacttcatcactgtctctgagggagacagacacacaagagcttgctggcagccagctagctccaagttcagagaagagaccttgtctctcgggaatatggaagagaatgacaaagtaggacacccaatatccttctggcttccagtcattcccactaaaaaggaaatgaccacactactgtgttccatagctgtggtagggtggaactgtgcactgggcttatgcagtgggcctgtactgtgaacctgtgctgtgggcctgtgctgtgggcctgtgctgtgggactgtgctgtgggactgtgctgtgggcctgtactagacctgtgctgggcacaggcagtagcatatcatgacaggagtgcatgacagagcaaagccactttccccatggtcatgaagcaaaagagagaaaagaggaggccaggtcccatcatcccctttgcagacttatgacctaaagactctccatttaactctacctctaaaggtcccactaactcccagaagcaccacactggtgatagaggctttggaaacactcaacatccaaactatagcaatacttttggctgaattaggaagaaggaaaatctcaactgatctgtaataagagattgaattgataatcaggaatttcccaataaaaattttggaccaaatggctacatcagtgaattctaccctgcatttaaagaaaacaaaattgcaagccactgtctcatttttttcctgtctcagttctgtctttttcctttactgattatagccactatctctttttaagatagacacttaggtcattaaaaaaagtactagcaaatataattaggtagcacatgaatagaattattgactatggccaggagagtggcatctcataacataaaaataaatatataaaatctatcatattaataggacggaagaacaaaaaacacacatggtcatttcaactgatatggcctattatgattaaaaactcagaaaaacaggggaaaaatgacatgttctcgatgtgaaaatagaaataacattgtattcagtagtgagacatggaaagcttcctaccaccgaaaggaatccttgctgatccttgacactgtactgaagggtcttgccagagccagaagacaagaaaaagaaacaaaacccatcaaattggagaggaagatgcacaactctgttatagatagtgtgattgcaaagagtctacaggtgtgttagggtttctattgttgtgaagagacaccatgaccatggcaactcttataaaggaaaacatttaattgggcctggtttacagtttcagagtcttggtccattatcatcctgaagagaaacatggtggcatacaggcagacatggtgctggagaaggagctgagagttctttatcttgatctgcagataaacaggaggagtctttgtccacactgggtgtagcttgagcatatgagaactcaaagcagctgacacacttcttccaacaaagccatacctaatagtgccactctctatgaacttgtaggggcaattaaattcaagccatcgaaacaggaaaactatcaaggttgatttggaaaaacactgcctaaaaaaaaaaaatccattgtttctcaatatagccccaatgatcagtatgaaaagggaatttacgaaacatttgcatttatattagcatccaaaaatttaaaaaattaggaataaatccatccaaggatgtcaaaactataaaccatgaagcctatgagatgagctatatagccaggcatgtgatatgtatgcctttaatcccagcactggggaggcagaggcagacatatctctgagttcaccaccaatcccctataccaccccccatccactccccaggaagcgtaagacctcccatggggtatcatcaaagtctgtcacatcatttggggcaggacctagacaccccccccacccctacccatgtgtatctagactgagagaacatcccttcatagggaatgggctcccatagcccattcattcactagggataaatactagctccactgccagaggctccatagactgcccaggcaccccagctgacacccatgttcagtgagcctgattctgtcctatgctggctccccagatgccagactggggtccgtgaactcccacttgctcaggtcagctgcttctgtgggtttccctggcatggtcttgactcctttgctcatcactcctccctctctacccctgattccaggagttcagctcagtgcttggctgtgaatctctgtttctacttccatcagctacaaggtgaaggctctatgatggcattcaaggtagttatcaatctcttataggagaagggcgtttaagggagcctctccactattgcttagattcttagtttgtgtcatccttgtgatctgtggagatttccctagtgccacatttctcactaaactcataatggctctatgtattaaggtatctcttttcttgctctccttgtctgttcttcccccaactagaacttcctgatccctcatgttctcctcacctccctcccctcctccccagtgctcccaatttgctcaggagatcttgtccctttccccttctctggaggtccatgtatgtctctcttagagacctccttgtttcctagcttctttggagttgtggattgtaggctggtaatcctttgctgtatctacttatgagtgagtacataccatgattttctttctgtgtctgggttacctcactcaggatggtttcttctagttccatccatttgcctgtgaatctcaagatgtcagttgtttttttttcccaatgagtagtactccattgtgtaaatgtaccacattttctttatccattcttcggttgaggggcatctaggttgcttccaggttttggctgttacaaattatgcttctatgaacatagttgagcatatgtccttatggtaagaatgtgcatcctttgagtatatgcctaagagtggaattgctggatcttgtggtagactgattcccattttcccgagaaactgccatactgattttccatgtgtttgtacaagttggcactcctaccagcagtggaggagtgttcccctttctccacatcctctccagcataaaccatcatcagtgttttagttatgaactacaaaacctgactttgtcagattctccatggcatttagagtcacacacgtacaaaaacatacatttgcatacacataatatttatcctgttctgtttctctgatagtggtggtttgatatattattcagttaggaaaaattcctactgtatattttttttaaatgatgagtttctgtgtatcatgtatatttaggagcccatgtagaccagcagatggcttggtttacctgaaacaacaggtagttgtgagccaccatgtgggtactgggaactgaacctgtgtcctctgcttgtcttgttgactgtcttttgccttacagaagcttctcactttcaggaggtcccatttattgtctagtgctagtggcgttatgttcaggaagtggtatcctgtgccaatgggttcaagggtacttcccattttctcttctaagagtgtggctgaatttatgttgaggtctttgatccatttagacttaagttttgtgcatgaggatagatgtggatctatctgcagtcttctacatgccagcatccagttatgccagcaccgtttggtgaagatgctttatttttccattttataattttagcttctttgtcaaaaatcaggtgtttgtaggtgtgtggattaatattagggtcttcaattcaattcctttggtccacctgtctgtttttgtgacaataccaatctctatagtagagcttgaagtccgggatggtgatgcctccagaagttcctttattgtatagggttgttttggctatcctgtttttttgttgttgctgtttttccatataaagttgagtatttttttgtgaataattgttctgagattttgatgaggatcacattgaatctttacatcgtgtttttggtaagattggtggttttactatgttgattctacctatccaagagcatgggagatctttccattttctgatatctttaatttctttctttaaagacttaaagttcttgtcatacaggtctttcacttgtttggttatagttaccctaagatattttatgttgtttgtggctattgtgaagggtgatgtttctctgatttcttttttagccttttatcatctatatatatagtagggctactgatttttttgagttaatcttgtatcctgctactttactgaaggtctttatcagctgtagggttccctggtcaaatttttcaggtcatttatgtagactatcatatcatctgcaaatagtccaagtttgacttcttcctttccaatttgtatccccttgatctccttttgttgtcttactgctctagctagaacttcaagtacaatattgaagagatatggagagagtgggcagccttggaatgtgcactacttttacagaggtcataacatcagtttctagcatcctgatgaatgttcacaactacttataactccagctacagagagctagcattctcgactccagtcatctgcattgccacatgcacatgggtggactcacccaattaaatgaaaatatattgttaaagaaaaaaaacaggttgattttagaatgtgtgaaaaacctaaatggacatttctttagagaggtaaggcatacaagtggcaactcagcccactaaaagaattgtaacatagtccttggctagacaaaaactaaaaagaaacttataacaggatactactaggtcaagtgaatagaattgtgtaccctagaatccatatatcgaagccttaacccctcatgtaagtgtgtgatagggactttaaggaggcaataaatgaggccatttaaggaggtttataagaagatgcagacaccaggcatatttctttgtgcctgaacagaagacaggacatagcaagaaggtggtcacatacaagtcaagagaagtttcactagaaatcagctctatttttggggacagaaggatgctgagaatcaagccccagagccttgtgcatggtaggcaattgctatactactgagttctcttcccaccattgtttctgagatgccagtctggaacatgctatgtggagcatgctggcttcaacaggtgacctgtttgccctctgcctcctgaatcctaagattacaggtgtatgtcaccactcagagtgtcctggtttgcttctctgttgtgataaaatattggccaagaccagcttggtagagggaggatttatttaatcttacaactcccaggtcccagtccatcacttagtgacatcaggacagaatttcaaggcaggaactgaaacatagaccaaaaaggatcactgcttactgacttgctttcaaataccccaggagctaggggctcctacatcaattattaatgaaagaaaggtccccacaaagttacttataggcactgatggaggtaattcttcagttgaggttccttcttcccaggctactccagtttgtgacaaattgactgaaaagaaccagaagaccttttctactggccatcttgttttggggcttctaacctctagatttaaaggaatacatttctgtttaagccaaccaagtctgttctgtcttgttatagcccaagatgattatagaaatataaaaaccttctgaaaatgtttttgaggatgcagacaaattggaatcttcttgtattgctagtggaatttaaaacgctgaaacctctattgaagagttctgcattttcacaaaatgtcaagatgaagaattactgtgtggccttgctatatactacagaggtattctgtgtgtatatatattggcttgttttgtgtatcaactcacacaagctgaagtcatcagaggaaggagcctcaggtgaggaaatgccttgatgagatccaactgtaaggcattttttaatttagtgatcagtgtaggtgctgctgtccctgggctgttggtcctgggttctaaaagaaggtagactgagcaagccataaggagaaagccaataagcagctcctctccatgttctttgcatcagttcctgcctccgggatcctgtcctgaccctgacttccttcagtgatggacagcaatgctgaagtgtaaacctaataaccctttcctccccaacttgctttttggtcatggtgtttcatcacagcaatagaaaccctgagatattgtacatgcccatatgtatttgggtatacatgtgtacatttttgtgtgtcatgcaggtgttctattcatgtcaaggtcaagacagccttagctgttgttccttaggcaccgtctacctttttttgagacagtctctgattagccttgaacttgcctagaacactaggctggtttctttgtaagccccagagatataccttcgtccatctctcccaacatgtgctactgcctgatttgtttgtttgtttgttttgtttttttgttttttgttttttgtttttctgagacagggtttccctgtggctttggaggctgtcctggaactagctcttgtagaccaggctggtctcgaactcacagagatcctcctgcctctgcctctcgagtgctgggattaaaggcgtgagccaccacagcccggcgatttttatttttatttatttttaatgtgagttctaggtattgaattcaggcgctcatgcttctaagcaagcactttgcctaaagctttctgctcagccctatgtggaagtcataaagacatttgtagacccatgctgatagcagcaataattcattaccaaaagttagaaactcaaatgtccatcaatatgactaaataagcacaatgtcttgtcgaaacagtagaatatagatgttattcagctataaaaagaatgaatttctttatattgcttggattaaactcaacaccttggatgtgtagacaagcactcctctgctggtccacactcctggatcctgaaatttgattcttgatacaaagatggaccttgaaaaaaaaatgacaagtgcttagtgagatgatctggatacagagggataaatagagtcatcatactggcataatgtaggtaaaacaggcccagacatggaatagaatggaggccatgttgtgggtaggagaagtcctgattaataggtacagtgttggatatgctaagagtcaggtgtggatggtgctggtgactgcataccattgtatatgcaatgccaatgaattatacccttacacatagtgtttaacatggtaatttacattgcatatacttaaacataagcataaaaaggccattattttattagaaaggtctttaggtgtcagtaggaaaaatcttttttttgttgttattgttttttcgagacaaggtttctctgtcctggaactcactctgtagaccagactggcctcgaagttacctgtctctgcctcccaagtgctgggattaaaggtgtgtgctactaccacctgtcaggaaaaaaaaatctgcttaggcttctgacaaatacagaatttataaaatctcatttttgcttgaaaactcaagttttatcattgaaagtactcagtaatttttcttgatgttaaagacccagtcaagacaacatttcacaaaataaagaagcctagagaatgcaatcattggtcattctaattcagacagtactgtggcaggtaagataactcagtagataaaggcacttgccaataagtctgataacctgagtcctatcccaagggttctgcaagttgttgtctgacctttacctatgcactgtggcatgcacatggaagcacacatatgcacatgagtaaatagttttttaaaaacagtactccatgtgaaagcccatattttacctcagtcacctgagtgttttagcacgagacatctgttctttaatagaccatgtaagcattgtttctgtcacatatctttaaattgtggtaaacaaacacacacaaaaaaaataaaaacccagcaagtttactgtcttaactgtgcatgtgtaggtatgtgcctccatacatgcaaatgtaaagggcagaggtcaatattgattgtcttcctctgtcactccccacctttcctgttttgagatgtcttacgctgaacctggagctcttcattttggccacatttgtctggttagtgagcatccaggatttgcctggcttcccaaagcccaagtgctggggctgtagattgtgcatgccacttcctgagccatgtctccagctccatcctgctgtaggtgtgcagttgacaaaggttttcaggacatttccaccatacagatctgaagcttccatgcttttgtcatacagaatagatgagcactctgtagctgtgatgtcatagagttaatttttccacttcatccagaagtaaagctacttttttttctcactgcaagcacataggagggaagaatatagtcattaataaactttgaccacagccccagcttatgtcaacacaccatcgctgttaggatgtcctgttaggatggactccaacacactagaaagagacaacagtgtcttagtgttgtatggagacagtttgggtttgcaggcttttcgagggttctcctgtaccctccagggcctgcctgcactttgagaactgctcatgtggatcactgtcttaggaggatcttggtgtcaaggtagaggaatagtgaatgcaagtagaagaaggcctagactcgaatattcaaagggttcttatgaaagacagaccaaggtggcaagtattgcagagggagaccaatttaagcacattcaggtgtgactttaggaaggtgagattgctggtttcatcctgtcagactttctctcatttccatcattcatttttatatagttaagttgaggtttgctctagtactgtaatgttgagagagaaaaaaactaatctcaaacaaataatctggaagagtaaatgagctgttcaattttctttttagagttttagtgaattatggcattgttctgagtgctgtattggccctatatagcaacactcctgtcgatgtgtgcatcaatagttaaggatgtccttacatggctcacacaagttctggtgatgagaacacagtcctcttgtttggggtaaactgctgataccttttcctcttctcaaacagcagttcaaatgcgtcaccttccgaaggtgcaccactcacaggaagctgcagctgcactcctcactcattcccaaagttccagcacccttctcatgaactgctgaaggaaaacggattcacccaacaagtgtaccacaagtatcgtcgaagatgtttaagtggtaagatgcctgtcctttgcctagctgtgttggcatcatagggaactcagtcagaatggcaaggtgcctgtccttgtctagctgcattgatgttacaggagattctaaaacttgaactgtcacttgatatcttgctaaaatagccttttattttgttgtacttacaaataaacacttttaatttatatattcctgtgttttttacagcttacacacattagtaaatgaatttagtacattcttcttgctactgttgacaagtacttataacttgagcagtgtgtcatagatttactgttggtcctatatttaggagaatctcaattactgtttcagggttggtgttgtttcattttgaggtattatttctttccagagagaaaacgcttgggaatcggacagtcacaggaaatgaacaccctctttcgtttctggtccttcttcctcagagaccacttcaataggaaaatgtatgaggaatttagacaacttgcttgggaagatgcaaaagagaattacaggtcaaacgtttcctaatgctttttctaattttctttttaaaaacacaatttcaagtagtctgattttgaaataaccacaacataactggaatgaggattatatttgttttttgttgctacatagtaaataacccgtaaactcaagagtaaaatgaacatttgttaactcctaaggacaagactataggagccacctagccagatagctccaacccaacgtccctcataggatttcattcagggtatttccctgatctctgcaggatctttttggtatccttaccttggctgttggccaaggtatcatttcctagccacagctgccttccatagagtatttttcagtgtagctattcacagagcagactaagaaagaagggcagcttccaagacagaatcctcagtacttgtcccaggttctctagggagtttgaagaaataacatggaaaatgcttttctgatttgtaaaatgagtttatagtcctcttgtcaatagatctgctgtgaatatattttagaactatcaatatccatttaattaagcttataccattatagttgaagagataaaaaatgtggactttttcagacaaaagattatattcaacaaacaagtacataatttaaactttgctttgagaaaaatctaaaacattttcaatcaatgtcactggatcttttgaccagttgggaaataacactgtcctgcactgatcagcatgtcagttaaaaatctgcactatccaagaatttatgaagctgagacagaaggctggcaagttcagggccaactaaaactacattgtgagttctagggtagccttgagtacagagtgagacactgtctcagaaaacaaaaacaagaaatactactgaaattatctctgttaaggtttgtgccatgtttgcttgtatgagatatcactatgaggtgctagcatgattctagcaaagccacaactttatacctttttcttccttcccacaggtatgggttagaatgtcttttcaggttttatagttatggactggaaaaaaaattcagacaagaaatttttaaggattttcaagaagaaaccaaaaaagactacgaatctggtaaaaacaaacactgtgtttgtaaactgtagacttgaactgtcaataaatagaaagggaggctgacaagatgactcagtgggtaaaggcacttgttgccaaacctgtaaccctgtaatgaaaggaaagaatttactctaaaaatctactctaaaaagcatcttggcctgtacctactttgtgtgtgtgtgtgtgtgtgtgtgtgtgtgtgtgtgtgtgtgtacattagtgtgctcatacacacacatacacacaaacatgcagttttagaaaagaagaaaataatttgtagctttttatcctcaggacaaatcatttaaggtcctgcccactattgttagttcttcatgctggtgggacaccatgtagtagtgagaatgctcctcctgtgaagctatttgtttgtttggttggttggttggttttggttttttgagtcagggtttctctgtgtacctctggctgttctggaacctgctctgtagaccaggctggccttgaacttacagagatctgcctgcctctgcttccccagtgctggtgcctttaccttatggaggtgtaagtcaacattaacttcttgataaacatggctactcattggtgtgcttggcaaggcaaatgagaagcgtgggctctggtccatataactctgagtccctttctcttgcttagtagccatgtgacttccacttcctccaccttgccagttcctgtattcccatctgtaaggtagacaagaggaaccatctaaccaggctggttacatgaggttcagattattttgatctgtgattaaaaacttaaatagtatctgttatataacaaatgaccagtgaatattagctgccaccattgctaatttactgtgtcttaatggaccgtaagtggtttactaatggtgggatcatatgcatgatagatttgttagttctgtataacatatattcttttgtttttaaggccagctatatggactggaaaaattctgggcctatttgaaatattctcaatctaagacacagtctgtggacccaaaacttcaggagtacctctgtagttttaagaagttagaagacttccgtgttgatgtaagttttaatttctgtcccctattgtttttatcacctgtataacttgataacaaatttttataatgttaatcttaaattttttagtttttaattttgaaattttaacttttcattttgacatcaaactttgaaagcaggtacaaaaatagataaaaaaaaattaccattattttcttcatttagatctcccaaagttgggggcttgggagatggctcagttggtaaagtacttgctaaagctgcagcagatatcccagccatgtgaaagctgagcacagtagagtgtgcatctataaccctgaactggggaaacgggtgggaacagtggccagccagccctatccaagggttagtgagagcccatgtctccaaagacagtgtgaacagtgacagaggaagatatccaacatcaacatctggtctccacatacaggttctcacacacacacacacacacacacacacacacacacacacacannnnnnnnnnnnnnnnnnnnnnnnnnnnnnnnnnnnnnnnnnnnnnnnnnnnnnnnnnagagagagagagagagaggagagaaaggagagagagagagaggaagggagaggatttctcaaatgtgaacaccttacataatggtacacttgtcagtgcatttgaatttggatatgcaaccatacttatatggtctctaggctgaggagataccactggtgtttctgatgtgaagctttttcactaaattttgtctggtttagctttggattgttttccatgctaaggattgaaccaggggccttgtgcatgctgagcaagtgttcaccactaagctgtatcatcacccaaactttgtaccttttttttttcgaagattactttatttgtgtatgtgtgtatgcatgtatggagacaacccacagaatccagaagagggctttggatcccctggagctggagttactggaggatatgagccacctgatgtaggtgctaggaatcgaccctgatcctcttatctgctctctccagccccaactttctatttattttttagaattgaagatttttttaaagatttatttatgtatacagtgttctgtctgcatgtatgcctgcaggccagaagagggcacaggatctcattacagatggttgtgagccatcttgtggttgctgggaactcaggacctctggaagaacatccagtgcttttaacctctgagccatctctccagccaccaactttctacctttttttaatgtgcttttatccatataattttataggactgctaatatgcatttagagttccttcatcataaaaattagtgtaagggctgagcctagtgtgtgtgtttgtagcttggaatgggtagattcctggcaaattaatgctgttaattggtaggtactttaattggtttgatttcaactgcaaaagaaaagggttaaaccaagaaaataactgcaaaggaggaaacagggtggggggtggggctgaaaagtagaaaaggtgtcattcctggctcaatgtaagccacagatgtagaccatcaattccaagtacaacagaaggagggaaaagatgactggcttttttgtctttgtttttgtttgttgttgttttgttgttgtttttgttttgttttgttttgctttgagacagggtttctctgtgtagctttggagcctgtcctggaactcgatccataaaccaggccagcttcgatttcacagagatccacctgcctctgctgggtttaaaggcgtgcaccaccaatgcccagctgaagatgactgttttaacttgtttatttatttatttatttatttatatttatttgtttgtttttcgagacagggtttctctgtggctttggaggctgtcctggaactagctcttgtagaccaggctggtctcgaactcacagagatctgcctgcctctgcctcccgagtgctgggattaaaggtgtgcaccaccactgcccagcttaacttgtcttttagattaaaaaatattagtctaactatatttacagttggatctataactgtataactaaaaaaacgcctcaaagcacttgttttaaatacagagtaccttctctcttcctgcttgcagtctaaatgagtttgaaggtgtttaaatttagtatcttcaataatgctatctagtccctctatcatgggaaccctgggtgaaatgtcaaactggcttgaggctgtttagcttggcacttttctcccctttctggttctattcagctgttaaacattagacactagagaggcccagaataggagctcagtggtaaggaagggactagaattgcaacacatccaagtgttttttttggagggagggaaccctctgtgcttattccttaaacatgagaggagcttctccagttcttgtgactgaacaagctaatcccagtctgccaaggaaatgtgaatttaatcctgtgagttgctgtaagaattcattatactgctgaagtctacaaagcaccaatatgaatcccctggttggtaagtctggctttacactctgagaggagtagtgaaaagtgtctactatgctgtcttttcatgctttgcagccccctattagtgaggaatttggaagaaaaagacattcatctacttatggggaggagagtaatcgccatagacttccatctcactcctccacaccaccaccaagtgttgctcagtctgcatctgccagtgaaccacaggagaaatcctcaggcacccagtgacaactcataccatgacagtgctgcctcggcctccatgggtgaagtaccagggaactagatgcttccacaaaagttgtgtgtccttgaaatcaacagcagcatcttctgatgtttaattgtgataatcagaaaacaaaaaggaagaaaaatggttgtctatttttctagcaagataaattctacacgtttaccccgattccacaaacaaacaaggtctggttgacgttaggagatcctgtagtaatgcactttggcctcagattttcttgaaggccaatgtttacaagagcaaaattcctttaatacatttaaacacacacacacacacacacacacacacacacacacacacacacacggaatacctgacatttcagctcatccttcttacagaagatacagtatgttgtattcatctcttctatagaactcttaaagagtcagtgaaatcgtcccactgtcagtccatatctgaacttgttgaaagcaagaaaggattatgtatataggttttaagttcagaaatggatatgaaagatattttttcttgtatatacatagtttaaaagaattttttctttctttttttttttttttccttttttacacaaaaccatgcacagcagactggtcgtgaggactataagctttggctgttgctgatttcacagcgctgtgttgatgtggagctttctgaattggcataagctgggtatatagagtcagagagactgacttttgtgattctacaaaaacttgcacatgtaattaaaaacaattgggatctgttggaagtgtaaataaattgttttgaatgtgtctgctgtttatatctacaggtgggtgtgtcacagcagtctcataaccagtcacctaagaaaagcatttagttttttttctttttgtttcttttaattttgtcttatgctcataattgttttcaagagttgagacaagttgatttctaattcttagtgctattgcaactgatgtaaataatagttttattttgtggaatttaaaaataaattattttgaattatttgaattgacttaaattttatttatgctatatttacaaagctgtagtatttgaattctactacatcaattgttattacgttttgttagtgaagttctagttacaaagttcttaggccgtttgtactgagcatagtatgattcacaagtactttatcgcactggcagaaacagctagtttcaatgcattacagttattattttctttttgagcagactggatatcttatcttgttctcataagttacatattaaaatgctctggggatgtgactagtggtagagtacttaccaagcatttacagggctctgagttcaatcctcaccattggggaaatctaccatacatagggatggtcatgtagctggggtaaaatgcttgcatagcactgtgaggcttagactgcatccctaacagaataacggaaaatgagagaaggatggggagaaacaaagaagaaagaaagggaaaaaagagacagaaataataccatcttttgagaaagggctgttgattcataaataccttttaattaggttgtcatgcataaataataacatgcagtttgtttactacaatgacaattttgaagtttcaactttagaaagcatagttgagtattcaaaacagcatttttactcacctatgctatagggaggacacaaaatcagccatgctcttgtagatttgagagggtgctgttcctgatcttcaggggggatttctgagccagtaagttttgttcaggaaatatgagctattatctatgaaagtgtggtcagtttgtaatgcatattttatgatattattttgtgtaaacatatactttgagaaattcagaaaagctcagaaaagaaaataaagcacctttttttaaaaaataaaaaatggtattatgttatacatatggaaatgtaacctgctggtttttactcagagaagttggtttctaatgatattcctatttttgcatagtaaccttcactagatacacagtgtcccagtatattgtgcacatatttaactgtttgtcaattgttgaactcatccgtggccagtttggcttttatagacaaccagttaatttataatacccttacatacatatctatgtgtataagtttggagttattacctagaataaatctccagaagtttacattcaaagtcaaaatacacctacttggtgccctatagtgaggctggccagtatgtgcttccttctgtctttgtacacaccattgacaaatttttcttcctattaaactgagaaaaaaatggattgttataatcttgtcattttgtcatattttacacttttgggggacatatgcctaagtaagtatgcagaggtcagaggacaacttgcagaagtctgagtgacaagttgtcttgcctatgaattatattatttgtagattgcttgattgtgtccttttctttttcttaggagaatgattatctttgattaatttatctgacatcttacttgccaagaatattaaccccctgctgttagattttacatttgagtacagtttttgatgaaagttaaaattatatccctttaattctaaatgtaaaggtccaccaaataatggcatgggtgcttgaggaaaagaaaaatactataaactgacgataaatctaagtgatcagatccacaattcaagtcccttgagatcctatccttttccttccctggaacaaggatgaggcccacacctgtcatcccagcaagtcgagtagcgtgtagctaaagatgatcttgaactcctgatcttctaactcccaagtactgggatggtcactgggaccaccatgtgtggtatagattttattttgatttttctgaacttgttttgacagctggaactccagcctggcattttcttagcatcttgttttatgctgtggtattaacacgttcctttatatgctcagtcttttcccccaactaattccttgtgtctattcttgcatgggagacagatccaatggaataatgcccaattgtatatccactagatggcagaatagaataagtcagagctgtaggcttatgacatgggagtgtgtgtgtgtgtgtgtgtgtgtgtgtgtgtgtgtgtgtggaactcttacttcatcttgtggtgatatagaattatcaatgacttgaattcctagtattcactcatatttctccctgctaatagtaaattattctgagctatttcatcattggtatagaggacgttaaatttttgctttggtattttgtacttccacttaaaaatttatgattaactctcttggaatggaaaaaaagcaagattatcagatacatgcatttaaatgtctggccaacataaaatatgtagttaaatcattggtaaataggtcctgcctggaacatgaggaacctagctaggtgaatgaccaggctaggggtggggctccgaatcacacattgtaggctgtagcctgatggcgcttcaacattgtgaacctaaagtgtgttgtattacagctggaggtcaagattaaggtgctcatgggtaagactttattttttgtgtgtttggcatcttttggcagagacttgtctggtatttagataagtcatctcaggagggatatgattagaaaagaatacaatccccattttcccagaagtagagaaggtaaaatacaaaccaaaaatgaccatttttattccattattgtttgcagttgaggattacagactactcagaagtagtattttctggtcttaggtgtgaaggatctgtgctccaaggttaataggagccatctcaaagctgtaatacttgagagtatgagctacccttagggatgaacaaaacctataccaggctttccatgactgtccgaaactccagctccagggcatccaacaccttcttctgccttctctgcacacatgtacagtaacaagaataaaatgctgctttaaaagaatcatctatagctttttactgcttgccagtttgactttttcctgattttttttttaatacggtgccaaggattgagccagggcctcttgataggcaaatatcccacctctagatacaaccccatccctacttccagtgattctgtcttttctgtccagtgaaggaagatttcctaatagactgctaacaacacgtaatactgacgtaaaatctaaaccagaatgtgctactgcttttgtattttttccaggtgattgagtttacaaactatgcttttcagggtgggtattttttttttttgagatggggcctaattacatagtataaattggacttaaatttaaccaatttctgccttgacatagcccccctccccccccccatacatacacactcaggttcaggtatatcaccactcccacagtgttttaagatgtgttgatttttattataacatagatacctcagtaatgtttaatgtccaaattggtttgcagttgtatatccctaagtataatctaagcccacaggcccggagcttctttgacaagaacaatccacataagttatcatgctcgtaggttttaaggtgggaagttaacacctgctactgggaaactgcttggcttatctgtggagttcaggctcctcttgctaagttactgtccttcaactacaaagtcctgtttatcttggggtgttgtcagaacccaagcacagcactggacacagatggggagccccatgtaaataactgcttacactaagcactcactgggcaagtcttgcttcctctaggaagttactaatgtacccttccatcagtggttctcaaccttcctaatgctgcgatcatttaatacagttccacctgttatagtgactccctcccatagaattatttcattgctactgttatgaatcatgatgtaaatatggtatacaggatatctgctattcaatccgaggggtcgtgatccccccaggttgagaaccactgcttgaagtgaaatcaatctacttaaagctcatgttctttgcacttgcctatagatgagttaggactgtttttcctgccttgtttgtgtcaggttcacccacctgtcagaagcaggagctgcaacctctgttactcggactgaacacttgaccgcagggcagtttccttgggtctcaaatgctgcccctctccgtgcctgggagctatttggcctcattatgacccttcagatccagagctagataggattgactgctgtggctttgcccgccagctgaggcacctctgtatggcacccatttccagtttggacttgagctcttcagaaaccatatttttgttcactcctgagaatttacccctggaattcttccataacttttacaacttttataccaactttaacaatagctgattcccagcatatgtgttgtcttctgtatgattttattacaggtcagcctgtgcctgctttttcctctatttaggttgaaaccaattttaccagataccctgaccgaggaggaaccacaaagtcgtgaccacgccggcctgctttattctcgtcgtactttgcagtgtcacttttgttaagattcagaattacagtatagactttaaggaagcccaggtgaactctcatatgttctatagctgttggctaataccaaaaattgccttttctttttttgaggtaggggcccatgcagcccaggctggccttgaacttgctgtgtaactgagatgaccctgaacttccgatcatcctgcctctgcttcctgagtgctgggcttacaggcatgcacccccacacctaatttaataaataaagctttcacaagtcttcctaaagtttacagagtatataaaacacagccttgctgtgctatgtggtgatggcagtgtcttcactttcaaatatcagtttcccagaaacaacgatttttacaactgtgcctgaagcttttgttttcccagcttgactatgtttgaactattaatgcccaaagcatactgaactgacatagtactagcttagatggtcacaacaatgtgttttgaggaagaagtatcaggaaagtaatggtccaggaaaaaaacttggttttccattgtagttgaccagaaatgcagtctccggccacggctcttttcaggaagcatgaaggaaacacaggaaggaggagaacacctgaaatccatctgccacatacacagccatattttgtataatgtcttaaactattgaaggggaatgtgtgaggtgctgaagcaacactgtgagtgataaaaacagcaaatgtggaaagggcagaattaagtgcacagagatagcagtgtgcactgaaatccttcctgtctctccagggggtggagcacccatgagactcaagcctgcttattgctaagcgtatgcagaactgcacagttttttttttttttttttaagttttatgtgacagacttgtggtactaagtttggagaattctctaaccgggacctggttgtggttctgttagtggtgtgtaacaaattctgggtgagtggactaaatgatataatgtcatttaagggccaaaagaagacatcagaatacttgacaggtgtgtcaaaatccccatctcggggccagagagacagctcagtgggtaaaggcgctaaccacagaaccacacaatctgggtccaatctctaaaacccacatggtgaatggagagaattgactccctgcatgttgtcctctgactgccatgtacatatcacagcacatatgtccacatgcaccccctctcaccccccccgtgtgtgtgtgtgtgtgtgtgtgtgtgtgtgtgtgtgtgtgtgagagagagagagagagagagagagagaggagagagagagggaatccgtgtgataaaactttcccatttagtactggcatgttggccacacttttaattctagaacttaggatgctgagacaggagggttaaaagtcccataatggcctgggtaacatagcctggcccttcccagaaacagtgacaacagcagcaacgaaattttactactttgggttgtcaagtcagtttggttttacagagggttataaaggaatgatttgcccatgggggcatgaaagttctgcagtgttcaagttccccagggccacacagaggtgggctgctgccacacaaaagagttcatgaatatctcagtggaggagaaagctttgtgtatttttggctcatgtccattatgttatttaacaaggaaagtcaaaacatgttttaatcaagtcatattaagtatcttttgattactgtgaatcctcatttcatctttttttactgtatgtttacaaagtacattatttttaaatagtgctgggtttctttgggggcacagtagcagcaaaggggaagtgggaactctggacctgagaagtactgtgtacatggtaggctatgccagtgggtattattctgctccaaaatttagaaaagtacacacaaagtcctatcggacagtaactgactcccatattaaaaacctttggtagaaggtaaaaattatctacctaggaaaaatcaatcagatcccattatttggaaatgaaagagaagctttgtacagatagaagggaatcagcaacaggagtacagaaagtatcatctcagggcacgtggcacgaggcaaataagatatgctcacatgatgtgaagagactgtgatgatacccagagggtatcaagacaggtatgaatttctgccttgtggaatcctgctggatccgcactaagttcagccttgcagccatgcaaggcactcttgctgtgcctcgcccagtgccatcccttgcctcagctctgcactcagaggaatttcactcctgacccttgcattctggcacagccttctgccttccacatccaaagtcatgagaagggccagcctcactatatcccaaaacctgtctaaaaaatcaaagcagaacaagaattgcttatggctcctgggcctttggagtttaggttagtttctgccttcagcagtcccagctgtgacagctttctgtttccatgatcatttttaggatttgtctcaccttcctttgagctgcctctctgatagtttttgttgtttctgttgtttttagtcctaaagggatcagttaagggaagcttaacataaagatggggggaaaaagtgaggaagaaaaggacatatgataggtaggactttatttgggggttggtagaggaggaagggagggagaagggacctgggatcgtcatgtaattcaatcttgtttgtaattcaaatatataaagaataaaaaactaaaaaaaaaaaagtaaggaagaagagagagaaggagagacccctactagctgcagttacacagtttacaaatggacaaaatgtgtttggctcacttgagtatccccaaatattacataacaggcaacatgggacggagaggtgaagatgccccttcctgggccatggggcttggtctgcacaccacaccagtttcccagggtactacagcaattgtttgttcatagatgccccgtaagctcatggaggtggctaagaattaagttgcttattaattcatttagtcttgacctacatatggttgaataatcacagggccatctgtcttccttaattaacatgcagagatgaagagatttttctgtacttctgtgggtggcgtgaatcctatcaagcagcccagagtgacttgtcaggagccctggcaattgctctgaggccaacagccaaaggaatggtgtgtttgctatttgggcagattgtgtctttttaaaaggcctcctgctgggacaggcctgtgctcactagccagcactgccagagtctggtgatcagctttaactcttcctcacaggctcaggcggggaaagggggcttccctcagatgctcaggagttccctctccctcaggcttcccagcttctccagggtctttctttggctgtgtgacaagagtgaaagcagtctgcaacagtgtggcttcttggttagccccctgcgctgctggggtaagaagccgttagttgaaactcttagcaataaactttggaggatccatgaacctccatgaccagaaaatcctacttaatggttgtcaagggcctgaccaagaatgctttgtgactctggagagatgggagatcaatagtcttgtgaatgataacacctgagttagcaagtgcctcagtttattgcaaggactgtcacaggctttatgtcagtctggcctcagtgtatctctgggaggccaacggagcaggtaatgtaacccccatgtacagatcaatgaaaataaaagattgagggaagggcttcagagagctaacactgcgcctgctctctctctctctctctctctctctccctttctctctctctctctccctctctctctctctctctctctctcccccctctctcgatgtgtgtgtgtgtgcttgcactcttgaatgtgtgcgcgcgactattcatttgtgcacattggtgtgtgtgtgtgtgcatgcacacgtgtaacagtgtatgtagaggtagaagagcatgttggatgtctttccgtgtcactctccactttgtggagacagtctttcattgagcctggaactgatagccagctagccagcaagctccaggggtccccagagcttcacctccccagagcaggggctgcagatgcacactattgtgcctggctttttatgtggtgctaggattctgaactcagatctgagtgcttttgcaacagtgtctttgctaaaagagcctctgtgcagccccaagcctgttgctttttagtgcagaattggaacttgtcttcattttctgtttttggttgtttgtttgtttgctttgagatggtatctctgtgtacctcaggctgcctccaactcacaatcctcctgccttagctccctaagtgctgggatgacaggcatgcgccactgtggctagctagataggactgtagtattcacttctcataaagctctctataaactttggtgggttttcacacattgcttatgccacatccatttgtccatagtgtgactacattacacagatgccttacttgtccagaagtacagtgtgaaccactctgagaacacacattgactggctcttcaaaaggtagagagagctcagggctggagaaatggctcagtatataagatcactggttgctctgccagaagatctgggttttattcccagcacccataaaccacaaccatcccctatgcccttgtttagtcttctcaggcactgcaggcatatttacatacattcagataaaatacccatatacatgaagtgaataaataaaacttcaaggtggaaaaatacaagaaagcatgcctttggagcggtccccttttgtatgtgttcaccatactctcaaatctagctgcataaaaatgaccaaaaatattgaaaaagagctaaattgactttcatccttagtgcaaaacttataaaggtacagtgattgacacccgcagatgggcctgacatacatccagatgggcacagacaaccagaagtaaatatccacgtgcctgtgaattctaacaacacttccaagactttccaatagggaagcaactaccattccaacaaaagttctggacaagctgatctacgtgcaaaagagtgaggctggacacttgtaatactcaaaatggaatgaagacctacgaaccaacactataaacctcttggaatgaagcataacgaaaatctgtatggccttaggtttgacagaagtatcttaacaaaagcaaagggaaaaataggtaagttgtgaagggaccagcccccccatttcggcagccatgacagtaaaacgtgcttgctatgaccttgtcctagtcattagaaagtcagatccctgcctcatggcaaggaaccaatcagaagttagctggtggtgctatgctttacgactctgggtgtgctttacggacaagcgcacagcaatgatgcacagagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgaaagacccaagctaacatggggttagctcattaaacaacaataaagcctcatgcagtttgcagcaagctctcgaatctgcctggtgattggggtgaccgaggtcatggcatgggacccccggatacctgagtttttccaggggggtctaacagttggactccaccaaaaactgaatagtgtgttagctaccgtgctatatttaataccttaaccctagcaatcaagtggaggaaaggatgaccttgacttgccattcgcagttccagttcattgtggttgggaagacatggcagaacagctcagttcacatcacagaggaccagtgagcagagtgactgcgcaaatccaggcaggatgtaaccttcaaaggccctcccctggtgatctgcttctgcccaccagatcctactcccctcctctgttttgtttttcgagacagggtttctctgtgaactcactttgtagaccaggctgtccttaaactcacagatatctgtctgcttctgcctcccaagtgctgggattaaaggcgtgtgccaccaccacccgggcagaccctgccttctagtcttccaaaatagtgccactatctggggaagaattgctcaaacatatgagcctgtggggacaccagacccaaacatctgtcgtggcctggcacatctcagctttaatccacgacagtcatgaggttctacctgagtggggtgtgtagacctggaaactcctagcaacctagcggcaataaagatcaaacacaggcatcttgtcatcttcagagagctctcagttccatgctgtagaactagagtcatttctttattagccatcttttctgtttcttaaccatcctgtcaatatcacgagggaaccatttctctctttgttctttctctgtggtctggtcgctggcccctaactcctgtcctccctagtcattcacagatctagcatctctgcccaggtgaggccttctcagatgcttaggcacatagagatgcaaattaggaggcatattaccctgaggccatggtaaacaacagtagccctactggcattaacaatacaatagtgggctggagctttcaggtgctcctgtttagtgaaaccaaaggctggatctcaaaatattccatagcggaaatattttggtcctccacaaacatctgagtatcagaggacaccataaagaaaataaacaagaaaaccacagatggtagaaaacattttcaaatcacacatctgataagaggttaatatcctctggtatagagagaacggtaactcgacaacagcagatccaactctaataaacacaaagggttaaaaggacatttctccaaagaagatctatacattaggaacatgtaaaccagaattgtgatgaaatactggaatgttaagaggacagctgggcttgttcgttgcatgcctgtaatctcaacaatctagaggcagatacagagagtcctgggttcaacagcctgctttaagacaggtctttagtgttctccatccatttggtcactgacctcctccagatcccagatctcagatctccaaatatagctttgctgtgtcaagggcttctttaggactctgatttgttcattagtcagaggaaagggatgagattcagtatttagggcgaggaagccaggcagagacactaaaattctcctgggtgattgtgttcatctgtcttcctttgcttgattgcttattaaagtagtggaaaaaacctggcattcatgtgtgttcaaaggtaaagtatgtgtgactcacacctatcatcccagggtttgggaggctgaggtaacagggctgctgcaagctcagggccagcctgggctacaaagttacagggttgcttggtttacagagtgagatcccatcttgaaaaccagaaccaacaacaaaaccaagcatagcgctgctggatagtatgggcctgtacctagctaccttggaggctgaggcaggaggcacactagaacccaaatttgtgaagggaccagccccccatttcggcagccatgacagtaacacatgctcgctatgaccttgtcctagtcactagaaagtcagatccttgccttgtggcaaggaaccaatcagaagttagctggtggcactaagctttacaactctgggtgtgctttacggacaagtgcacagcaatgactcacagagcatagcaaccaccctgggagggcctatgggccataacaaccagttggccaatcaacacagggcaagccctccaagcctggaggcacaccaatcctgagcctgtgtgtacccctagacactccccttacgctgccctacaagatcactcggcagccagttcgaggtgtcttttgtagccatccgccatggtgggtggacaaaagacccaagctaacatggggttagctcgttaaaaaaacaataaagcctcatgcagtttgcagcaagctctcgaacctgcctagtgattggggtgaccgctgttgtggcctgggaccccagatacctgagttttctgggggggtctaacacatagtgctgctggataatatgggcctgtacctagctaccttggaggctgaggcaggaggcgcactagaacccaaatttggaggacagcataacaaaataacaatgaaaatcaacagaacactaaaaatgcaatgtttaaaaaggtcatacaatcatacaatatttgaataccactgagctgttgggtccatctagaaggactaattcatttgattttttagtctcaccagatatggtaactcatttccttctagaggggtggttatcaaaggtatccattacacaataagattaagagtgtcctgtcgtggagaagaagggattagtatgtgcagaggtctagtgatgatggaggaggagaggcaagtgtggcggtgcctgcctgcaatcaagctcagctcttgggaggcccatgcgcgagtgtgagcccctcccataatagaggtgacctgtccttcccagctgacctaacaaaggtctcaagaacagcccacgtagaggtgtttcttactttcccagttgacatcctttcctgaaagcaaggaaacattaaacagaatggagaagttagagctgggaaagttagagctggggaaggctggtccagccggtgtcttcctggtgctaagcaggatggtgagtgtccacgactcagaccctcccactcctagtacagggggaaaatacacactggggagacttgttgaagcagaatctcactttattccaacaggcaggtacttatatagggttgtggttggggatgcgaatcttaggatggggtaagatgatgtgaggagtaagggccaataataatccaccaagctggcaggtagctaggcaggggggcagtcttacatcaggccttgctgagtcacaccccctcccccccgccccatgtggaggttacaggccagagacaggtagccaaactcaagtcaggctcaggaggttacactgggcctcacatctgagcctttttaggcccaacagaaatggtcatgtcaaatcctactagtcagcgtggaagatagtgctgattcattctataatgattataacttaatttaatgactccctaaaatatcaacatttgtatttttatttaagattatatgttttatcccataaaggaatagaggtgatttacaagaagtttaaccttatgttaaatagaaagtttaaagacaaattgcttaagactggatgtgagtattagagaatactcctgaatccccagcactaggaaggtgccaataggtgaagggaccagctccccatttcagcagccataatagccgaacacgtatttgtctgaccttgtcttagtcactaaggtcagatgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaataaagcctcatgcagtttgcagcaagctttcgaatccgcctagtgattgaggtgaccgaggtcctgggctgagaccccggaggcctgagttttccaggggtctaacacaggcagatcaagagttcaaggccaggagctggagaaatgacttagtagttaagaacactgactgctcttccagtggaccctggttcaattcctgatatgcacgtgttggttcacaccacctgtaactctagttccatgggatcgattgccctcttctggactccatggacaccaggcacacacatgttgcacagacatacatgcaggcaaaacactcacacacataaaataataaattttacaaaaagagttcaaggccagagtcacatacaatttgagttcaagaccaggctgggcttcatgagaccctgtctcaacaacagcaattataaaacaaatgaacaggagctggagtgatggctcagtgttaagaactggtcttccagaggtcctgagttcaattcccagcaaccacaggagatctggtgccctcttctggcctgcagagatatatgcagacagaacactgtatacataataaataaataaatcttaaaaaacaaataagcaaacaaaaagctaggagagcatagcacaatactttcaagacgatgatagcctaaataaaaaaaggaagcatgatagccgggtgttggtggcacatgcctttaatcccagtacttgggaggtagaggcaggtgaatctctgagttcgaggccagcatgctctacagaatgagttctaggacaggctccaaagctacagagaaaccctgtctggaaaaaccaaaacaataaaaaaaaaataaaaaaaaataaaaaaaggaaacatgaggaattaaagtttcacataactcaattctgaaagggaaagaaaacatcattttgtatgttaagcatctgtgtgctgcctagtgtgggcaccatgcagcagcaagcccccttgaaatgcagtccttggtgaaggaaggagtagctggggtctgcctgcaatctctccctagcatttctctgaacaattaatccaaaggtactgtaaaccaaaggcaactgaaagacagtaaaacatcggatatcctatacaacattggggcaatcaggaaataagcacagtatatcaaacagactagatatcttcttgcgaatttcctttaaacttttggtatttgaacagtggagactctaacagcatgctgctttacatgagagagatgttcagctactctatagttggataagggaagatctacaaatattcagaaccaaataaggacagaaggaaaggtacctttacaaaaactgaaggtttcacacctcagggatgctatctcctgcaacttttagaaagcctgattcaaagaggatgaaaacctggatacctcagtatttgtttcctacaagtttccttaaagttatcgatgttcttgagcagtgcttggctaaatcccatagatttgggcatggggtgggaggtgggggtgtttccctttctattactgctcactattacgggcattctttcccccagcctggtcccagagctgtgtcagccccaaatgaacacataaacactatattaattgtgaaagtattggccggtgactatggcctctttattggctagctctgacttaattattaactcatttctataaatctaagtatttccatgtggtcttggcttatgagaatgccagacctgcaactcctttgcctggtacatctctgcagagaagagaggagagcaatttcctgtttgtccctgcttatatactgattccgcctagctacgccacttcctgcctgtctgtacagacctccagacctctatggttagctagtggcagtttctgcccagctaagtcacttcctgggatcacatgatgactcctctctgcctacacctcccagaatcctacttgtctcttagtcctacctattatcctgcctagccaatcagtgttttattcatcaaccaataagacaagcatatacacagaagaacattccccatcagctcactcccgtgttgggtgctgtttttagtttccaagtgtaagatattaaacaaggtgtccttgggtgctaacactatggcaaggtcaaaaaggtattattctccttggcacttctttggctattggtactaatgcattaaactactataagtttttcttgtacttttgaaaagaaagcccactgtctattgaatgccattatccaaaccagggtaaacttactcatttctgccattcaggtctttgcacaagcgtctctacatagtgccacatatggatctagaacacaagtgcctggagaaatagctcagggggtgaaggcacacactgctcttgcagaggacctgaatttggttagagcactaccataaggtgactcatggctcaggcacttctttagactgatgagctgtttacttcccaagtctctggaacccacccccaccccactcccagccctcccccttctccctgatgcctatactttaattcagaggacactgctatacaacacagtagttccaagtcctcctgaagaggctctactggcctctcttggcccctaagcactgcactcacacgcacatgccaacaaagggacacacacacacacacacacacacacacacacacacacactacataattttaaaataaaacctctaaaaaatctgggccggcctctgggggttcacgcctttaattccagcactcaggaggcagaggcaggtgaatctctgtgagttcaaggctagcctggtctccagagaaagtttcaggacaaccagggctgttacacaaagaaacccagtctagagaaacaaaacaacaacaacaaatctgagcacaaaggtactatgatgtcaaaaatgtaggataatttcttttttaccagtgtggatgcattgcctatttaaaaaaaaaaaaaaactgcaaaaatgcaagccatgcaacacaaaaagtattgacaacatgcagtgacgggtctctatacaactagggacatcatgaacaaaggtactagatactgacagattggaaggaaatttttgcaatggtttaaactgacaagggtactgggtacataaggcaatggtgaacatttgtctgccatgcccaaggccatggcttctaactccaacaatacaaaatgaaagaaggaaggaaaggaagaagggagagggagagaaggaatgggacgggagggaagagaaggaggaagatggagaaaatacaaatcaacaagaaatacaggaagcccacaaaaaaaggacatgaataggcaagagaagagactctcccaaacaatatacacataaagaaatgcttggagtcattgtaaagggaatgcacagtgagatgcctatagccactagccagttgacaagctaggtattacatttccccaaggaattcttacacacaagggaagctgtatgagggtgtctaatgcaataaggatttggagctgagttgtgtagcagtttctttccaattaaagcattgccttcaggagagaggagggagtatcgtgagaatcaggaaatatatggcttgtcagtctgaagtagttcatggaactcacagggtgctcagggcttctccccaaggtgatgggcttgtaaacagctgtcagtgagaacagcctacctctggagctgcctgtgagttgcagagagctccagggttgccgatttccctggtgttcacctgtgtttggggtgaagtttctagtgatgcagctgccttcgaattatgtctgctccttaaggtacccctctgctgtattcctataagtgaccccgctgacctcagtggctcaccaagtttgatttgggtgtaatggttacttcattaggtcatcagtttccatctggattgaacagacatttatcatgtctcccaaggaaaaatctcacacaacaagctggaagcatgcacttctgtcagctgtagagagagattggctgttgccccaggaatatagttcaaatggcagagtacttacttagcacacacagacagagtccagtcggtagcattgtttgaaccagatgaggcacgcttgtaatccccacacttgggagtggagcctggagggatcaagagtttaagatcattctacaatttgaaggtaggggggctacatgagagaccatgccccccaaaagcagatatgaggcaattagcaattagacacaacatattgaatacacacagtagcaaaagaaacagtaaggagcgggccataacagagctatcccaggactcatgcacagaagacaacaatacacattcaaaacacagatagagctggagggacagtcagtcaggacacacttgtgtaagcatgaggagctgagtctgatcccagggccctcacaaaaatgttgggcatgatgtaatcccagcatggagtaggcagatgctactgggctcactgaccctaacctaactgtcaaattccaaaccaatgaagatccctgtctccaaaagctggtgagatggcaccagaaaagtggcatccaaggtagacctctagccttcatgtgcacatagaagcacacgtacacatacaatgcatgtacaatctaggaaatgggaattccaagggttttttgtttgtttgtttgtttgtttgttttttgaggcaggatttctctgtgtagtcctggctgtcctggaactggcactgtagacctcgttggtctcgaactcagagatccacctgcatctgtaaccagagtgctgggattaaaggtgtgtgccaccaccacctgacaaggaaatcctaagctttggaactcaagacaagcagtgcacctgaaacagaacccttgaattttaaggcctgggatcatttgagcagtattgagttaaagtcccaatctaagcggtagatgtagatcaacacggtcaaaacagtgcttttgttgtccttaactacttgactgtatccaaaagcttgctgggctggagaatgaagacaagaaagataatgatggccattgactggtatgccaaagaaagagtcctacactacttcatcctcttagctaggatcagtttataaatagacaaaagggatgtggctaccttgggagatgtcaagacacacaaagtacttctgatactcagggggcaaggaagatcacatgggactctgctgaaatcgggagtgtcttgtgtgctcagcatgcttggaaacaacaaaggacactcaagatcagacactgagaagcaagatctggagcagtgtcctaaagaaggtgaacgattttgttggcagtggtttggatgagaatggccccacaggctcatatacttgaacatttggtccttaggaggtgcaactatttgggaagagttaggaggtgtgtgtcactggttcactgggtgagggctttgaggtttcaaaagattcaagccatctccatcctcccccgccctctctgcctcctacttgtggatcaagatgtgagttctcagctgttcctgccaccttgcctttgctctgccatcatggattccaactcactgaaaccctaaaccaaacattttctttctttttttttttttaaacactttcttttaaaagttgccttggttgtggtattttgtaacagtaacaaaaaaaaaagtgatgtagtgttcattcacaacttgggagatctagaatcgcctgggagaaggacctctgaggatgtctgtgaggaattattgtaattaaattaattgatgtatgaagaccggcccactctgagtgcatggtttccctgcgcacaagattcaaaactgcacaactatggagcgagccagctgagcattgtcatgccctcattcatccattgctccctgctctttttttttttttaacttataaaaattatgtatatgagtgtttggcctgcgtgtctgtctgtgtaccacctttgtacctaccgcctatagagagaagaagaggcaattggagcccctggaactggagttacagagggctgtgagccaccatgtgggtcctgggaactgaacccaggttctctggaacagcaagcagccactgctctaagacactgagatgtctctcagccccctgctctctgctctttacagtggatgtgatatgttcttcaagctcctcaggagatggactgtaccccccaggtcgtgagctggaatgaaccattcctctctgaagctccctcaaaaggactcttcccacatcagcagnnnnnnnnnnnnnnnnnnnnnnnnnnnntgtgcgggctccagggctgaggacacaaatcaggggagatcaactgtgagcaagcactaagtgagagttcatctttcccagtgctcacaataagggccactttagagcgtctttgattcggtgaacatatagaagcgtacagatctaacctggctgtgtagagagaaggcttgaatgggtacttttgaatggacctaatgcaaaccaagttcacttcctgggattcacgtcatgttttcaaatgccaggagtattgttccctattgttgcatggtaaatcttgctctaagttaggaaaccaaagaacagtgctcctttgttcatcctttatgtgggttgcctaaacagcatttgccatgttttcagagacttagatgggatgggcttctttctccgtgtaagcctttcaccccatgatagacactttccaacaagtagcagctttgctgtctcttaaggtcagaaggcctgtgagctttttgctacatcattacacaggtcaatccaagaggatcccaaggtcaacccagactcaaagggtgggaagtgggtttcacttcttgaagtggggccattttaatccctctgaaagggaaagaattcaatatagaaccatgtttaattatagggaaggaaattttctctgtatctatacacagtttgtgtccctgcttgataggcaaagtatgcattaaacaaagccatcagtctttgctgaacttgatcctgaatatggtgtttgtcagactcgggggaatcatttcttggctatctcaacatgctgctagatacctagttaaacatccaatttagatcccttatagaggccccagagaagacagaatatgaggtgtgtgtgtgtctgtctgtctgtctgtctgtgtgtgtgtgtatatgcacgcatgggggtgggggcggtgccggcagtccccatgcaagaacatactgtgtgcccagcatgcacatgaggtcagagagcatctcctagggcttggttctctcctaccttggactgactcccaggatagaactcaggtcaccaggcttgcctgcaagttctttgatccaccttcccagccaaagagcacaacttttgaatagcttaggccctgtcttggttaggtttttgtcaacttggcccaagctagaatcatcggggaagaggaatctcattgagaaaatgcctccatcagatggcctgtgggcaagtctgtaggacattttcttgataaatgattgatgtgtgagggcccagctcgctggggaagtgggttcctgggcaggtggtcctgagttgtacaagaaagccagtaagcagccttccccatggtcactgcttgagttcctgccattaatttcctccatgatagactgtgatgtggaagtgtaaggcaaataaattcttttctcttcaagttgtttttggtcatggcctttatcacatcaatagaaagcagactaagacagagcctcgatttatctaagacctcaatgggaacatgtctgtgaaaatatccctgctttgtgtgtattaggtctcatacctgggacaaatggctaactgaggtacctatttaacacatcagagtggacctggcctccaagttctcccagcatccttcagtccctacctgtttgttacagggtatgactggcatacccagccccctaccctaaacttctccagcctaggggctgggctgccctttcctatataatccagtcgttttggttacctgtccttttcttctaccctttcctctcctggcagtctcctctcccctcgccctctccttacatggtccagctcagactggtcttgtccactctggactctcccagaggtctctgcctctgaccatgctctcccttttatctacaataaactttctcttccaccgtgcccaggagcagtcatgtccttcttttttattttattttatttttttcattcagtgtgaacttcagggtccatgcaaaaggcttacgctgaatttaactgcagaggtagctctggtggtttaatccacagtcagtaatgaaggctgcgtggaggaatgctggccttgaacttttagcagttctgcctcagcttctttgtgatggcagccagtgaaggagaacccttgctgctgtggatggagacagagaaagaagagttcatctgaaaagtgttttttggtcgagcatggtggcgaacacctttaatcccagagcagaggcagatggatctctctgagtttgaggccagcctgttctacagagtgagttccaggacagactgggctacacagagaaaccctgtctcaaaaaaaaaaaaaaaaaaaaaaaaaaaaaagttttgaagcttggctggtggggcagggctgtgaacctagctacttgaaaggatgaggcaggaggattccaacttcaaggacagccgaggtagctgatatcttgtctcaaacatttttttctttttctttttaatgaagcaaaaagaaaatctctcttgtgtcccgcgcgctctgtatttctcgccggcaagaaatcacacacgggacactcggatccttctgcagacaagctttaatgcatcttatgaggggagagcataagctttccagagcggagacatgagcggggacactaaaccaagaaaaccatcccttataaaggctgaccagccacctgggacgtgttaccctatgaatggcttcagctcctcaggccaaaatgagccacgggataggcagagatcaaaggaatggagattacccagcgcctgtgaagtaatttacatcttggtgtcttcaggcacctattattgtaatggataatgcaggaaccggcttcctacactcttggcttttttcttttagaagcaccccactttctgttttacaaacaggaccctagggtctctggtctaggagattgcttggaatcctttgcctggtgttgacttttctgccacctgtctaagtgagcaagtatgagcaggacttggcgagagcaaggaacacaagtgtcctgcttatattttcatcctgcttgcaatgtaaaggtcacatacctgactggtcaggccccctgggattttctgccgcatttctttactgtgatagaagggaaaataccagttcattcgaccttgggatactctcaccaggccctgacttctgttctttctttcagggttctggctgtcctctgggtgctccagccagtgctgactgtggtactattccttcagtactctctgctctctgcctgcctgtgctgcctcccactgtgctggccatacaagccatgtgcactctcccagagagggcttattgttgtgaaaacctttgccacataaacaggaacatggcacggactcttgcagatatgagtgccagcaaatgccagcaacttttctcttataacctctggagtgcaattgcatcagctcagccatgtgactgggaataccagcctgaagaccatctggtaaaaatgatccttcagcctggtggatggcaccatgcccaggtgcctcaggcggatctgcctcatccctaatttctaaaatacccacacccctgagttctgacacggtcttagaaactgggtctgctctggcataggctagaggggtctaagcctgggttgtttgccatgaggaacactgtcaggggctgctgtgtttctgggttaatctgaggtccaagtttggcttcaggacagagctatctcagttcagttattcatctatgagcagatacagtctgaggggctagagataatgtctgtgccgtcccagaaagacatcagagatggagtaactcatacacaggtgaaatctatttttctccattctagagactggaagttctcagtgaaaatgctggcagattagtgtcttgtgaaggggtttgctcatagacagcaggtctgcttatcctcatagcaagagtaggaaagtgtttttcccacaagccctcctatagagcactaacccagtcacatgggcagagtctttatggccaggtgactcctaaccagagggaccccaatatgcagaccacagcacacacaaagccaggaaagatccaatttataccctgaaaggtggttacaggaaggtgaaggtcccagaggagggaaagacagctggcttatgccagtgtggatgctaccctgttggccaagattagcattggcaccacaagggtttgggccacagagagagcacctctcatgctggggtgctgttaatgaaggctttgtagagataacgattcattctcaaagagaaaaacattagaattagctaggcaaaggagaactgcacacaaatctggaggggacagagcccagaggcctggagtgtgcagtaggagcaggctaaaccaacaacatacattccagtccttaggaaagtgttactggtggttggggtctgtaccagatgtttccaggttcttggcctcttatctaaggatcaacaataagggctcataaagatttgcaaaagaagcaaggcctcaggctacagacattttttttttttttaaatagtgtccaaaaggaaggagggttacttactcagacatatgtatagttagggtggttctctatttttgttgatagattagctgatatgttcatctttcttctttccttgctttctggtttttgttttgttttgtttttcaagacagggtttctctgtggctttggaggctgtcctggaactagctcttgtagactaggctggtctcgaactctcagagatctgcctgcctttgcctcccgagtgctgggattaaaggcgtgcaccaccactgctcggcttcctttcttggtttttgagacagggtctctctatgtagccctgtctgttcttgaactttctacatagatcagactggcctcaaattcacagagatccatctacctctgcctcccaagtgccgggattgaaagtatacactaccacagttggcataccttcacttttcttaaatgttcatgtccttctccataatgcatctaattttaatcataggcctatacacttatgcataggcataagatgataaacagggacttcttcctaaaaggttactagaggacacagttttgactcattgtgtatgaacccaaagtgagttctgacctgattggtccttttgtcctactttatgtgggtacattgggaatacgtttgaatagaaattgtataaatctggttgttaccaggggcaggggagcatatcattgttcagaggtgggccatgatagctcacagtgtgtactgggttcactagtactggttccagggttgctaggtatattgtttagagaggagtgcatgtgtatagtgcacgtaggtgaaggaagagctaccaagtgtattacgacaggaggagtgagtgtgcataaccccaaaccaaataggaccccaaggaacaaaactgtctcctaggcttgcctgcctcaaaaaggcggcaaaagagctcccggtggtcagatcttaaagtgttaagggactgcatacctgggaagagagattctacggagcgaatgagagatggagaaggggggggggctttttggatggagaatttagcagggttggatggtaggcctaggaagactccaggctctggcatgggcagctaaggacaatgttgctggcatgtgagcaaggtggggggaggaacagggttggggagcctgtggggcctccagtaggaggtgctcaggacacgctatccatcagacctccacggtaagagtcatgagcattatccaggagtgtactggacaaggaaagaggaggccctggggcattggtaaaggaagctgctgtagagggagcagaggacgtggtgagggtctgtggtgagggtcagggagaaagaaacagggagaaagaaagtagagcaaacacagctgaacatgggggctgagagttctgccaagaatgggtggtacagtgggaaggagggacactcttaactgtgtgagaaagcagcttggttgggctggctttcagcagcttgaggatgccatttcagagtccaccacactgtctaggttagttagctctgcgctcactgcattcagccccgtgagaagctgcagaaagcacaggggtgctggaaacgagtgctgtcttttcagtctgcaccactgttcaccagcaaatcccctcctttcccgggggcctttcccttctggtacatctaaccacggctatatctgaaatgaaaggaaaagaaaacaaatacaaacaaaaaccaaacaagaccccacaaaacaaaatagaaaaaaaaaataccaaacacctttcccacataattctttccttttggttgtctttctgcttctaggatttatttctattagttttagctgtatgtaactgtatgtgtgtgcaggtgcccatggagatcagaggcatggaattccttatagctggagttacaggtggcttgtgagccaacagacatgggtactgtgcacccagtgtgggtcctccacaggagcagcactgttaacttctcagccctcggtccctctaggcatctgtccactggtcttctgagttctctcttcgggaccactttccgttcagtgggggtggagggttgtatgccaatagcactagccagaggcatcagctctttctaatccttcgtgggagggaagggggaaatgcctccaccggaaacctcaaagggcaaatccatagtgtaaacatcacctttgaccacaccacgtgtttgagttttaaaaacacttgtggttttcttcgcagtgtggcagctgtggagcaagagagaactttgccagaaggttcttcatcctcgttgagccattgccctcaaatatgcaagactcaaagaccaacagaggccactgagagagatgatcaccctaagtaacatcggaagcttttgcctgtgctcaatggagacttgcagacagatgttttcatagcattttaaatgagttattatctgaagatcttacacatgtacacattatattttgatcataaccatccaccattaacttccctccagttccccatactccttcctaacttcaccattgaatttgtcaaacatacttccctaccagatgctttaattcattggatcataaagaaaaggaggtaagcttttggggtaaatgtaggtattctaggtactattgaaatcattttatttatttatttatttatttattgattgattgattgattttccgagacagggtttccctgtggctttggaggctgtcctggaactagctcttgtagaccaggctagtctcgaactcaattgcctatgcctcccgagtgctgggattaaaggtgtgtgccaccaccgcccagctgaaatcattttatgagacttgaggttagaaagagatggctttatcagtaacattatgaagtgatacctataggaaatcagtgaattcaatggatttataaaataacacccagtaagaagtcatttatgttagaaaaaaaaaagaggaggggaaataatcatacctagggctttagagtttttgatatgtgccagacactgttctggctgctttgcatgatgggctctgggaccctcaaatctaccctctgaattagtcagattcagatgttaagtgtcttgctcaaagccatacagatagtaagtagtggagccaggctctaacccatgctgttagtctagattccataacctacctgcgggcatggctcaggttatatgagtataaacactaaaaggaaaaggtcagatatattcaagtaagtgaaaatggcagtcgtctggggcgagaactgagaactgaatttggggcagtcaattccaatgctccattaggtgaaaattttaagtttcttgtgctttcctccccaaagagaatggtttcatgttgcttctgaagctaaatgtatttataaataatttctaatacctaaaagaacatcaatgttgtagtcaatgctagtgatttggagcagagtccctagatggtacttttcattgtaaatgtcagatgactgttgtcattgaggtcaggatagtttcatctttgctgctggacaatcacatgacttgcttcagagtaatcaaaatgtgtgtcatattggcaaatggagtctcccagagctgagagttcagaagcggaagcccaggtggtcctagcagttcaagtattgaattaagccaagaagacatttgttacctaccttggttaggggttcttttgttgtaatgaaacactatgaccaaagcaatttggggtctagtcggcttctacattgctgctcaccaccaaaggaagtcaggacaggaattcaaaccaggcaggaacctggaggcaggagctaatgcagagggcatgaaggagtactgctcagcctgctttcttataacacccaggactaccaacccaggggtgtcaccattcacactgggtgagcccttccccatcaatcactaattaagaaagtgctctacaggctggcccacagcccagtcttatggaggcattttctcatttgaggttccctcctctcagatgactgtagtttgtgtcaagttgacataaatctagccagcacattgcctaattacaaaaatgaagaaaaaattttaaagagggatactattaattaagaagtttccctatattggggcagccacagagagaaaccatgaggggggatgaaagagggagagggagagagagagaggaagaggaaagagagagagagagagagagagagagagagagaatgtgaatttaaagacttggcttacactcttgagttctgaaatctgcaaagccagctggctagacattcaggtaggtgatgttgcaattttgaatccaaaacctataaggttcacagtaagcggaacacaggctggctgcttgttctgaaggtcttagatgggtttgatctattgtctgtccacacgagaagcatattgtttaatggctgactccacattgcagtcatgtctacaaacactttcacgaggtttattaatcaaacagcttcaaattgaggcccagtcaaatcaacatacagaatgaaagtctgagagcgtatctccaatgagctaaaatctggctgtccaagcaaatttagtgatacttagatcatggttttcttttactcaggactgacaaagcattccctggctttagagagtcaggtggttgttttggggaaacctctgctcagcatgtgtgtggtgtatctactccttccagtcactcattttgcttaacccaagttggcttgtgatgtgattccaagttattttatagcagttgaaagatcaactgaggcaaggcaaacaaatccatgggagtaaccagtagataccagacttgtgctgtcatctggcattttcaattttctgctagttaaaattagttaacacactgtggactgtatcactcttcttcagtgaagacatctaccacaagctcctcacaatttaatttctcagttccaattctggtatcttaactagattcaccattatgcaaacaattttagaaatcacaaccatttgttcagaagccaaataaattagaagtgaggagaatgtgtgtgtgccagaggacaatttttctttctttcccttttgttgtgataaaatactcagatgaaagcaacttaagggagaaaagatatattctggctgataactcaagggtacatacagtccatcatggtggggaagttgaggtgccaagagcttgtagcagctggtcacatcacaaccacaattagaaaacagccatgagcgcacaatgatgctcaggtctcacctggtcaagatgaaccatcccacattaaatgatgtaatcaagacaatcctccataaacatggccagacacatgtctccagttgactccagagtctgtccaattgccaacactatagctgaaaggttcaggcagatacctaggcagcttaaagggcccttgttgcatggccacatcatggctatgtcattcattatggggctgtgtagggactcagtgcgcatgcacgaactcccccttttaaacctgcagcattattctcctttctctctctcctctcactctctctctgccctgctctgttcttccatttctctcccctcccctcttgctctcccaccctaccataaactggttaatgtgctctctatggtccatgtccacctctcgaatttgtaatttaagcaaaagaataacaatagcaggtgttgtccttcaggtggcatctactttctttctttctttctttctttctttctttctttctttctttctttcttccttccttccttccttccttccttccttccttctttcttttcttttcttttcaagacagcgtttctctgtggctttggagtttgtcctggaactaactcttgtagaccaggtggtctcggcatccactttcttaatcagggcctctcactggcccagtaggctaggctgcttggttacatgggttgttgagctcggacttaggccttccaagctcttcactatcccagcactgagaacattaatgtggaaaccatccatgccttgagcctgcatgctgaacttagtatctgatgttattaacattcgtcattggttactactgggtgaactgtgggggaggcagagaacagttttcctattgagactatcagtttaactaccaaaggataattcagtttgttagtaaattgtatgccacctaaagatactaaaggctcaagaaaggaaatctcactccagggcccaggtacttccatacttacacgacacatggacaggagcaaagtactcccttctttaagaactttcttacgtgagacatgacttaactctatcttttccctgttccctacttctcactgctgtaaggttagaggtctctccccctaggagagtaagattcctcccacccccaggaaagcaccccaggttcaggccagtttccatttacctttgtcacactgtagtttgtttttttaaaaaatattttaaaattatgtgtgtatgtgtgcatgcaggtgctgtggcattcagaagagggcattggatagatcccttggagctggagttctaggcagtttgatccatccaacatggcagcttggagtcatttgccagagcagtacatgtacttaaccagtgagccatctctccagccccttctagatcaaactgaagtgttaccttgttttctaatgtctcattggtatctactagaccccataaggagtgccagtaggtgggggcagtgatgagaaatgacttccctagggcagagtaacattaagttattctggtcacctgggctcactcagatccaggctgtactgctgaagtgtgtctgcctcgaaccgggtggaatacaacgccctgtagattttaaccttgtatggtcaactcttggcatcatcaacagtctcctcagcttttctctttcctacctctctcctctccttgaagcaacaaattaatttcaaacccaataaacagaactaagaaatgctgagatgtgccttctaggcattctctgaaaaccctggtgcttccttggtgccttggtttatattgcttactctctcagctctcaaattcatttgaaagttgtatcaatcattttatgtagctaggcagtgtagtaaagtctgagaaaaaaaaaatattgggcctaaaattgaagcctcaatctggatgctggattatcagggtagataattacatagtaacttcaaggctacacttgtacctgctatcaaggccatgggggcacttgagtctggctctgccttaaggagttagcagggaagttaatcaggaagggtgtgagaatataacccagaactgaaaaatggagcacatagtggtttgggatattctgaaagcaaaattaagttggcagtagctacatgtggcagttagtgaagtaggtgaggaggcaggcatggtgggcctacgctttcaatctcgaggtgtcaatgaaggtctttaggcagggacacagtgcgttcaagttagattgccaacaggtactaagaatatagcgacaataaaggaggctaagtaggaagataaactgggttgggggtggggtcacagttgtccaacagtgagcagcaggtgtagagaccacatattaacatgtgaagttccaggaagctaggcagagatgtttggggaaactctagtcttggattaagaggatgccctggaagtccaaacacaagggagcaggttggcaagaaaagggcttgacacagttaactgctgaattacaacttttgataaatccatacttttataattagcaaaaatacactttgaatttatcttctaagtttgttcttttctcctttaagcaaattcagatcagtctaatgtacagaacagtctgcactgtcactttcacttggaaatggctaaagagcacatttaaggcacatgtagatattcatcaggctgggaactgcaaacttatggaggactggctgggccctatgtgcaaataacactgcaggttcagacagtgctcacagcacctcacgtgatcccttcaatagaggcagggcagatggacagctgttgttcagcccaagattcttcagtgtctcagctgtgaagaggtggagttcctcacaatggctggcaattatattttctgcacaaagactaacggtggctggttattatggacctttcccccatagtcatgattagtattatttacccagtcaacagctgacctcagtggaccacactctgccttagaggcatcagaactacttttatctcagtgcaaaagtactcaactcttccaacaagctcaaagaaatgtatacatcttccaagtagaatgctgcgtctattccaactgctcagagatgtcaggctcgacactgttaacatcttataagcagacacctagcaagctgccacacttaagacagaaggaaggggggtgtgcagatgaggaggctggtttgctttccaggggacacagttttggggtttttcttttctttttttttttttttcaagacagggtttctctgtgtagctttggagcctatcctggcactcactctgtagaccatgctgatcttgaactaacagagatctgactgcctctgcctcccgagtgctgggattaaaggcgtgtgccaccaatgcctggcagaggacacagttcttgtgctaattcactatgctgacttaagcctagaagcctgtggaaagaactgaatgatcaagtctgcagctctaaggaaggggaagaattaggaaaactgcaccaatcagggtttgggaaacttcattggaatgggtttatcccctgcaggggacctcacaacttctactccaaggggactttggggatgctgcaagagacaaaaatctaaatgttaaaaattttactgccttcaaaaatttttttttttattttactgccttctaaaagcatggcttaattttatttaaaaaatgacttttaactcagtactctaaagaagctgaataagtcaaaatcaagtgtagggagctggagagatggttcagtggctaaaaccacgtgtgcccaccagattatgagagcttaattccagcacccatatggtgtcttacaagcatggtaaccccaggaacatgggatctgatgccctcttctgccctccgagggcaaacatatataaaagtatttaaaaacaaatgtggggaatcagaccaaaattataaattctatttttattgtatggcaaataaggagcatgaaacttcagaagatgaatgtagtgtttcgcaaacatgtcagatcctaaggatgattggaggaatcagaatcattacaaatggatttaggctcagcaggtaggaagagtgtatactttagagctgatgtagctaaatggttgagcaaagtgtgaagttttgggtctgaattttaaccctgaaggaaaaaaaagtgaatatgttttttaaactcctaacaagtaggcaatttgggtaaacatgccagttacagatccctccgagactgcttgctgtaccacgctacctgacaatgagaaatttgactggagttaccaaattatctatagaacacagtttatttcaagtccaaaacacaaaaccacttccttttaaaaaacaaaacacattgtttttactgcatgaatgcctgaggcttctcacagatgcagagtatcaaccttcaggtccaatggttcagatacaccagtttactacatcagaggatatatactttaacaatttattagaaaatattttacataaaaaagaaaccatttatccacagtctttagtcatcacatgagctcttcagccagaatctggtgacaaccacacttttctagagaatattccaggactgcataggagtgtagcattttgcactcttctgcttaccaggcacgccatcttgatggtttctttataacacacccaacaggcacaagtcttttcatgtcacccattttgggctttcctatgtgggagcaacttgtccctgaccaagaatctatcaagatgaagccaaaatgtgaactaagcaggctctgaagtagaactttcccaactaacaatgaagggatttaacagctatcagtaatactgcttgtttgtcagctactgcttggaaggctagtgcttctagcataaccagcggctcaaagcctaagtacaaatatgtacactgtaatacaccacttcttacctgaatgatcccacattgggagtgttccaccagggtggaattgcttcagaagttacattgaacatggtacatatacagcttggctaaccagtgtctgattttcatttccaagagttttttcctcatcctgaatcaaatgcagtcttagtagtatatgacacactggctcaccactctgcatttacatttagagtccaactcgagcttatttggtttattgtacatgctttattaaaacggtactcgtatttacagcatcgcagaaagagtccctcccaaggtgctctcacacacatcagactcacccacacagacattcataccacggccccacgcacccacaccagtgacatgtgagggtcagactcctaaaattaggcagctgttggggaagctgttgatttttcaatttttcttggaaaagaaaaaagcataggggatgcatttggccatcacaatgctagctatgtttgtgtattaacacatggcagttaacactgagtattcctcttacattctacatacagaatgacatcaacctcagtctcaatgctgcttgtagtgacttctgaattcacagaggggcttttcctaaaaataattcaagtttatggaagtgaaataaggcacaattaatattgatttgacctagcggaaggaagggaaggaaataaaactgatttcaaatgatcttagctgggaaattgctgacttcaagccactggaagtccctctaatttccaaatctttcttagaaggaaacttttttttccctcttccctgacgaagcccagaaaaaaaaaaagtttgggaattcacctttaatttttcagtagcctgacttcttaaacgaatgtgtaaccgccaatcccctgcccagggttcttcccttaacacaaataaaacagcctgtgaaacaggatcccttgctgtttccagagatctgtacacttgagtagcaaatacctatctggttgtctttgatacttttttgttttgttttaaaagagagatattgaaggggtggggaacaggaaggcagagagaggaaggaggaaaggaaaagagggaagaaagaaggaagagaaaggagagagggaggtgagggggtaaaaataacctggtgactttcttgcagttaagaaggccctgtctccttttcaggatgatgaagcccaccagacattacaaacaactgcaacagatccatccggcagcgcaaataatgaatgcctcatattcagatcttcacagtgaagcacatcatagtgtacactctggtgaagtgtttctcacagcaggtgcaccacacccaaagactggacattctctgaaaggagtgagagttgcagttctgaaggcccctggctttggttgttcacaaagttcaatcctgtttactgtgatccttggtgtcctcctcatctgtgtactctgatggttcttcccctggctttaggagtctgcctacataatcatatttttctgaaagatacaccaaaaacaaagtcagtaatggttaaaatgtttcaggattccactatactgcaagaaggctcttgcctcttaagtcatacagaataatgctttatttatatgcatgtaaggcctcaacagaaggcaaaagggactgaaaggtttaggactgctctttgagaagagttcagtattagtgggtcttattagaagttttaaaatgtacacgcatggactatctcagagctttggaatgtggctgctttgtttttgtggtgctagggtttgaagatcaagctttatgcaagtactctacccctgagctccattagtccaattcttttagctctttttttttgtttgtttgttttgaggcagggtttcactgtgtaactctggctatcctgaaactcactctgtagatcaggctggtcctgaactcacaaagatctacctgtctctgtttccaattcctttaactattaataactcaaaacattacatctaaaatatataatcagatatagtagttgatacatacagtcccaggacttgatctgctatgagtttgaagtcaatttgggttacacacagaaacatatgtatagggagagatcctggatacctgtaccgctgaccacaccggtttgggcatggtcacaggtatgtagaggggtaggataaagactgaggaggagaggcgctcggcctcttttggggttctggtcggttgttggagtgtggctgagactggacttcttggagtgccaatctggtttattggcttcttgtgtgagttgttctcatttataaatatatcatcatttataaatatataaataaccatatcctgtgtacggttgtgttccttttcacatatgtacatatataattggaaatttctatgtcatttaaacagtggattacaaatccgtggctaatattttggaatatcaaccatgcagaaggagcctttcttgggttgaatgaagatggggtgcacagcctctgaggtgcagaaccagagggtaaacagatctgaggaatattctggagagaaatatgtgacaaagtagtagggacgggaaacttgtaactcatttctctaggctttctgcaaggcccctaccacatcaatattctttcccagatcgaactctctccttagatgtgtactttgtttgcttttatgtgtcaaatgtttcatttagaatcttgtatgcaggttaaacatgcttggtttctgtctggaagcaaaaccttggctaagtgaattacaccacgactaagtagattagctgtggaaagggttagcagtgggctctgcacacaggaaaaccaagactagtgctgagaagctcagtgagctgctccaaagacccagatggctcaggcaatgtcacacaggagataaaagctgatattatgagggcacagtattccttctttacccagttaggaacaattaaatcattttgcaatacattatcattatagtgttgacatcacctattcatttttgttgttgttcctggttgtggtagttctcaaggcactgggacagaacccagggcataaggaggtcattacagtctactactgtgctacaccctaactcgtctgtatttaacaaaacaaaatcatttcctaatgaaccagtcttagaaaactattcaaagtattgcaatttgagattgttgggctcaaaggcatgtgccacactaggtgctaagtacattttcaaatatggacggactttttcaacctaattgtcacatgtaacagtactattaattaaaatacatcctaataatgatggaaataaaaatagaaagaaggtgtcctttaaaacattacaatagtatatattcagttttccaaatgacaatacctttaaactgcatttcccattctcgaacactctccatttgcacggcattcaaatctgagaggtcatcatactcatctctaagtgcatccttatccaggcagaatgtcgccagccccctggaggcatccctgccagcaaagatcccatatgggcccgctgaaaaagaaagagacagctcagagcctaaagccattttaaagtgtgtctaaacatctgggtcctcaccatgacctacagtggtgcatagtcttaatttcaaaatatggagatactggatgagataatcagagatttgttggaaatttcccttgtaccaaagtaaacgctgacaataaattcacttcagataccctgaaacttgtatgctgggagaggaggggtcagtgggatgcaacccatgagaggtcaccagtgctccagtagtaggtggctctatagccttgcacacactgacagcactacatgaatacattaaagcacattaaaattgggatcaaaaagttgtagtgggatagggaaggaactggaggggaggcaatggggtggatcttatcaaacacatcatgttcccgaatgaaataaacttacacctggagctcactgatttggctcttctggctggtcagacagttccaggaacccttctccaccttcccagcatgggcttacaggtgtgcacaaatggaccttgcttttaatgtagatgctggagatctgaactcagttccttatgcatatctagcaaatacttaactgtcagagccatctctccactcttacaacagaaatcttttaagcttaactgtttgcatcttatattgcagaaagggccaaagagatctttctgctcaaaatgtttctaaaaatatttagaatgataataagatctccaaaatgtatcactgtacaaatgacaatttctttgagttgatgagctctttcacagacggcaaaagtcattccgtgaaagttttaaaaccatagttttaaaaccatgagcagccagttactggcttaagaacgactctttaaaaaaaaaaaaaaaacttattttgtgtatgtgtgtaaaagatgtgccaccccacaaatgtagtccaaggacaaaatgcctcctgctttgggcctcagggatcaaactcaggttagtgcttttatccactgagccacctctcaggcccatgaaaactattaataatgggacttagttttctgagacaggaaaataaatctttcctattcagaagaagacctcagtacttactataagcggtaaattgattaatgactgtacttcactgaaaacatgactggggtaggaagtccattcatggagctataacggctctcccaagaggtttaaagtagcttttttaggtttggccatgaaggtgacaggtgtatagtgcttccagcttctttaattattaagtcttcttcatattaccaatggattaggtgactgctacaaattatagttaagtggctaaattttatctcactgaatggatgtatcaatgatttaattattctcccaataatacaaacattgttttgttccctcaaatgtgtcttctatataagaacaaagatactatcacctatcaatatttatgacttttgaatctttgctattatctgaacagacatttaaggagttataagcatttaaaggaataaatttaatatagtttctagttacagagtacaattcaaaagtccattaaattggagttaactattttagaggaaatgtaaacttaaaagtaagcaagaaagactcaacctacagcacctgcacccctgattctctttgtgcagaattctacctgctttgtagagagacaaacatatttaaagcagacaaagaacacagaatgagggtgggctttttatttctaggaaacaaagatgactaaagtctattagcgtaaagcagtggcaaataaaacaaagaagaaattataaaaatgacacaagagcaacaatcttgaagaggaaatgacaatttccattttaaagaatttcccagtaacttcgggatttcacgaagaaggaacaaattttgcttttttctcctcagtaggaagattaagtcagaacacagttttcagtggctcccctaaagttactgagagaaccggaacattggctccactttcttcatcactccaaacattgtgtctccaaaaagctgaggacccccaagctcagagcatttacactgaggccatttagggtagagtggcactccaagcaagtgctccaccattcactgatgctgcctcagctcttctcactttttactattttcagacagtgtcactaaggtgcccagctggccttcgactcattctctagagctgtaacaggccttaaacttgcattcctcttggctggagtgtaaactatgaggcctatttgagtgatgcataggtgaggaacgatgatcaacacttataaaaacagcaaacatgacactgcagactcaggtccacccctcatgcccacaaaaacaaataagcaagtcacagaaaaccctcagtctttgagtatgttactatacacaccagtaggttctcatgtaaatttctctgtcagcttccctaaggaagggtcaattttgaatcaatctgctaaaattttgttgctaaataaattttagttaaaattgttttttgttaactcgttaaaggaaaagaattagtaatatgttcctcatttcgaaaactacgttaaaacatccccttcacaaacacagacttcgggggaagagtcgcttgataaagagacctttccttacctgctctttgctccatgctgtgaggccactgagtaacctaagaaaactaagaactagggttggaattgggcagcctctcagggaggttttgaggtctggcaaaaatatgttttcctgcatttgtaacacaatcatcaattccttcccctcttagacaccctccacaagaaacaatgttatcagcaatagtattttgctaactaccagtggctgttcacaaaacaaaaacaacaaaaatgggagctacccaagaaaagcaaatctgatctagtgttaagcctctatagtataatttaccaaaaaagcaaatgctgttttctgagtgtcaagattcatttagacattattaccatgatctccaaccaagtaattggctaacctaacagcctttgactttatgatagtgaatacttggaattttgattgattcctggactaggaacaggcagaacactcagtacagcttccaagcagccatgggatgaagaatgtaataaatttcaccagataccaaacagtgcagtatgaaatgggctttatgtaaggtgagtttgttcaaccataggctaatgtaggtgtcattaacatgttcaaggcaggcttggataagctatgatgctccataagataagtgaattagatacattttttactatttccttccttccttccttccttccttcctcccttccttcctcccttcctccctccctccctttaaagacaagacctcattacacagccctgtgtggcctcaaactcacagaaatcagtctgcccctacctccagaatgctgggattaaaatcatgtaccaccatatctgactgtgattaagatttttttaaagttcaaagtcaataaacatggttaggtgtggtcagcattttggaggtgaaatgggaagattgtgagtttgaggtctgcctaggctacatagtgagacaaaacaagaaacatgaaaaaatctgagatgaaagtcaatcaactcattagttactaaaccctaaaactgcttattttttgatacaattgtgtagaatgctgacatatttttgaaatgctaacaaaccatatgcatataatggggcatatacatacacatgctcattatgaaacaatgatacaaaaataacaaaaaaatgtggtaagtaaataaaatcagtaacatgatttaactgtaggacgaaaaaggagaactattccatgataaaattatttccatggtttaaatccgttatctatcaagtgactgtaatgtatagaaattgcacactataatctgggaagctccaggacttgtagagccattgcagtaaagatgaagaatgtttctgttgagatgacaagacacttgtatgctggaggggccacccaccaggtaacaccctgatgcttcagacacaacacagagaaattattttctctgcctagagactaaatgaaatgcttcacatgactgaaaatcccactttgtttccgaatgtccaactagaaggcttgatcatacagcaaagtgcattaccttcaggaaaaaagggcgaactggagagctgtcatgttaaaatcagaaagacaaagagcctgtgcatggcttacctggtgaatatagattaaaacacatgccctaaagtagaatgaggacaaaagtaagggaaaggacagtgtaaatatgagacacaactcggacataaaagataaatctgaatacacaaaaccataaatttgtggtttaaaacagtttatagggatagataatgcagctaagtggtagagtgcttgcctagtatgagagagagaatccctactaccactcacaaaagcaaaggtaaaaatgctatgcagggttggtgaggggctcagcagacatgattgcttcccaagcacactgatgacctgaattctgatacccagatcccatgacagaaggagaacagattcctgaaaacagacctagaaacctccatacatacactgaacaccagcattcatgaatacacatcatagatacacataataataaaatatcaaaacagcaagggttagagatggttcatcagttaagagcactagataccaatccagagggtgtgggctcaattcccagcacctacatggtgactcacaacagtctgtaactctagttccaggagatctgatgccttcttctggcctccacaaggcacccagcatatacaagtacataggcatacattaaaaagccagcaacagactccagctatacattcagtggaaaggcactaagaacatatttgcagccaagactgaaatgatgaatatcacaatagaaaaaaaagtggcaaagaatatatggacaaaagtatatatacaaaaggaaacaaaatgactccgattttctttaaagatgcaaaattttgggccagggagataggtcagtctttaaaatgcttgccctgcaagcaagaagacctgggctggcaagatgtctcagcaggagctgtaacaggccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacaaacaaaatcccaaattcaatccctggaatcgacactgaaaattatacaagagggtgtgatggcatgttctcaatcctagcatgagaggtgaagacaggttaatcccttgggttccactaccagccagcctcatttacttactgagtgttctagactagagataggttctgtctgattaaaaaaaaaaaaaggtagacagcaactgagaaatgacgttcaaggttggcctctggcacacccgcacctgtatacacacacacaaactctctttctctcctccccacccacactcattcagaataagagaagaatgcaaattaaaatagtgactggaatgctgttcaacctcagaaccacaaaaagcaagcagtttaaagcaccacatttttggcaaggacgagaaacagagaaacaggcatctttgtgaagtacacacagttcaagctctctggggcaactccaaatgaagtccccacaccaatggccttaagtaattctgcttctaggactcacagctttatttacatatagaacactggtacaaggctgtttctcacaacatcattactaagaaatgggtaaaaactcatatgctcaccaacaggggttaaccagatatcgcccacatgatatgaacgatacgaaaggctctcatctcaggattgtgatactgcttgaggggatatacagtatgctataattaagtgtgggaaaataagactcctgttcagatgcttaaatctgcaccgtacagctctgcaacactcaccctgatctatttccactgcagagtggtatgagggggctcttaggaagaaccttatttttaactgtaaattctttggagttttcagtcttgggcatgtattttcttaaaaattttatcattaaggaaaaacaaaaaataaaccttacatacaaggccttatttggggatctacttcaaagcacccaacagtagcacatccacaatggacagttcatggaacactccaggatgtggacaagaaacaaagaatgcagtaactgatggaaagaagatgaaacaaaaatgacaagctatatgaagcaaggaccactgggtgagtacacgcacgtgtcccaagaataaagcaagaagagcaaaggaagactcaagttgtttaaaggttatcaacaactaagacacagggcataaagaagacagtcatgaagaatagatgaaaaattaatatacacctacctatcttccagggggaagataagagagaatgggggaggcaataatctacggacaggtttaaatgttctaaatgttctaaaatggacagatgacacatattcatcgacgctttagtagaatccagcagttccaatctagggggatgggagaagcttagccagtgaagtacttattgcacaactgtaaagaaccaagtttggatcttcagcacttgtacagaaagccagacatatgtctgtaactccagcctggcaagggatcatggatacaaacagatccccagaacttgctggcagcctaactcaaactggtgagctccaaattcagtgagaccttgactcaaaaaaataagatgacactgattccacctttgccttccacatgcagtgtacacacatacaaacaacagaagaggagtgtagatagagaaaatcatctcaactacaacatgggggaaaacagattattaaaagcaaacttctcagtaagaaaagaaggcagtggcacacactactcttgaaggtttaacaaagaatccagcatacaatttcatattctgacctcaaatcattactcctgaacaaggacagataagcacaggtctttttcctaccaatgaaaagaattagaagccttttagtacattgaagacagaactccaagaaagattgaggtacaagaaatattaagttgtcctgccctcccccgtttctctgtgtaacattctggctgtccgggaattcactttgtagaccaggttggcctcaaacacacagagatccatctgcctctgcctctgcctctctgggtgctgggattaaaggtgtgcaccaccacacctgactatgaatagtaaatagtaaattttcaaaaaggcaaccacattataaagaccccagttccattcacggcacccacactgggcagctctgggggatctaattccttttgctggactctgcaagcacctacatagatgtggtgtgtacacacacacacacacacacacacacacacacacacacacacacaccctaaaaaagaaaaaaaccttctagtgctacagggataagtgagaagtacagcatctgtcctaaatgcctaaatgcttgcagcccaggttcatgtaggcactaaatgtaagaaaaacctgtcaagtggctgtatggtgtcttcaagaagtaggttttcctaatttacatgatatttggctaaaattcttccattgttccaaaggtcaacatctaaaccatatcttaacaatcaccagaaaaatggaaacagatttatccaaatcagcagaaaagagaaagggaaggataaactctaagaagaactagtgagcgaagacctaaagtagagtttttttctgagctgaactgcattcagagcactgtcagtcacaaaggtgtggccaaagactgttaaataaaatggtggaaacaaaaacacaacaccactgacaaaaatgtaaccggattgagctatgagaacataaaatgctagtgagttcaaatctagttatatgttttggtttttcaagacagggtttctctatgtaaccttggttgtcctagaacttaagaccaggctagcttcaaactcacagaattctgcctctgcctccaattaataacatctagctatgtacaagcaaccaaaggttgaaaccaaacctggactatcaatggagatgatctaacagagaaataacccttgatcataaccctaatttcatccttttctaaaagagcataattacctactgaaatgtgtttgtatcctgcctgtccacagcgacgtcagatccatagatatggattggtctgtgccaaagactaattctacttctgaaattgacttatttaaagttttacagctatgaaagctacagtgatccttcttagcatttaaaaatggagtcgggttgtggagcactcgggaggcagaggcagggggatctctgaattcgaggccagcctgttctacagatctacaaaaggagttccaggacagccaaagctgttacagagaaaccctgtctcaaaaatcaaaacaaacaaaacacctttagttgggtggtggtggcacatgtctttagtcccagcactcgggaggcagagacagaggcggaggcggagacagaggcaggtggatctctgtgagttcaaggccagcctggtctacagagctagttctgcgacagccagagctgtaacacagggaaatcctgtcttgaaaaatcaaagagatgaagtcttttattaaagaccttgagaaaggatacaggcaccaagaattatatagtgatatatgccacaggtatatggggaggaatggcctatgccagattgcccaaaggaccttgaaaagcacatgtgactaattctattccttctaatctcagtcagcattttctggtctcaattttgttattttaatttgcggtagtacttaacataattcagttccctaaaacactaaaaacaacgcaatgatgcagaattcataagaggtaaccacactacagaaatgataagcacaatataaaactcttctgaacttcgctttctttaagacaggaactcacagacagtcatctagaagctcaactatgtagtctggttatcctctaactaaaggccatccttcttcctctgcctcaagagtgttggcattacaagtaagcattacaatgcatagctacttcagaaattttagctggtcctttatcttactggtagctaacaagatgcatgcagtaactagcccaaacaaacctagttggcttcaaagcaagaaattgtgatgacagatggattgtgacaactctgagatatccatgcaggagtaggtcaggctgggtttggtctttatgttgcaactcttgcttaaaccacagttttgtaaattaaattgttaaataaaattaacatattgaagacaagattaaaagggggaaggatttaggttcatgggtaccttttcccaacttcctattaggcagccccaagggctacttacgtggccttttccttttcagtagaatttataaggtaagttggctatagctttggcatatattgacaaatgagtaagggaaaaaaatatcaaatagtccaagtatatgcttttttgccattctaaattatattcctgctataacataaatatttaagagtatactattaatatattcaaaacctattctgaatgtaagcaggaattgataacgtgacaatgagaagattatgacctgtgaatcaagctggacttgggtttgatttttattgtggctacttagtagttaggttctttgggggaaaatccctaagtttcagttttcacaaatgcaaaacgagaatacaagtatcttgtagagacattaaaacaaaaaacaaacaaacaaaacaatgaaacatgctcaggaaatggtcactaggaactcctggggaagcagcacagcactccataaagaaccaggtttagtgtggtagccatgtggctgaggaacgtgcctacttgttaccaaataactcactttaaaatatattttaattagccatttgtggcttgggctaccatagtgggcagcaggaacaacatacacaccatgaaaatgaaaatatgttcaaagttcaaaacctgtataggaaggaaccaggaaagggtataaagaaaaagcagtaataggattctctttaagtttcttccagaagctgtttaccagtgtacaaaacttttgtggtcaaacatacctagagttttcagatttatctatgccatccaagccagcttacttaaacctcagacttatcactaaggcagatactttgcaacttcattaaagatctgcaaaaatgacaaatggttgatccaatacagtagatgataaggaatttctgtttacttcatgatcacactttctgtccaagctagccaagtgactgtattatattattactaaatataatactgataacaaagtcaacacattctggcaaatagttggcagtgaaccacatttaaagtattgctatttaattgtattttcaagaagcgggactttaaagatgcacagctaaagagaatgtgtctagcattacagggggaaaaaccctcacagaacaatctttaatcctaaacatcactgcaaaatgggaattgaaagcagtttgggtatagaaaataagctttccagttctaggctgagtttttcaaattactgagattctagctaaggagtgctgaactagtaagaataaaatgaaaatggcatcaagactcttggaaagtacttcaaagtgtccatccaaggggggaaaaatcaacagattgtaaggtccaaagatgctctggctacatttaagttttttcaataataaaatctttcggatattcctatgtttgtttattgatacctgtaataaaataattatgcaccaaaacaaggaagtggtctcaccatttgatcccaattggcctggaacgcagagacccacctgcctctgcctccagggtgcagggttaaatgtactaccacacctagggtggttcttcattatcatctcaagaatgtcttcagagctcaagccacagagacccaaaccacatacctcttactcttagttttgaacttctgccacacatttgcccctggaagctgcccaaactgactctttcctaatgtgtgaggactaataatggttctttttacaaatactctagacaatctttaaccactgaacacattttttaatgccactggggtaaaggctgtaactaggtataaaatctgtgtaaattcttgactttaaaaagtttatttgacttggtctgtgtaaataatatactttggtcttagtctcttgttcaacatgctcttaagtaaaatgtattaaccattgaagttgatgtaagcaaggggacatgtggtatttgtttgtacatccagaatgtgtgtgtgtgtgtgcataatgaaacataagctaaaaaacagatccaaaaccaaacactccaatttcttacctctaatccacacaaacccaaacacttctaaaatagcgtccagctaagcactgaaataagaagcatgttcagtgtcaataaatcacacgcactaacaaaattaaaaggaaaccctgtttaaaagttggttgtagtccttccaggatagggtcacttctggtctcactttattcttattgtaactgctcccccccccccaaaaaaaagcttaacccccaaagcttaatattaatcactgaaaaagcaggacacacagttgcttaattttatggactttcaacatattccccgagtttggagtttatttgtgtaatctgaagcagattacactataaaagggcttccacagcaactaccttccacatagtgttctcaaagcaaagttgtaaaacctctaacttgaacaaccagtgcatggtagggggaccgtctagtctttgcttttctatccctcccctcagttctgctaagggaaaatataataattcatcatcaacgggtatttgaacacttatcatactactggcagagagagagcgcgagagagggagggagggagggagggagagacagagaggagacagacacgcctgctaggcagatgagctccaccccagacgctcagggccaatatcgttgccagtcttatttattaatatctacattatggttcgtcctcatctcacatacagtgttaatcttggaaagtatcttggagccacaacgggctttttagaaaaagaaagaaaataggtccgacgtggttcttacagcgactttcagggctggcaagggttgggacttgaaactacgtgtcccaaaccttggctctatgcagactagtccagagaagtaaagagtaggtgtcagacaattcagcgtaaaaagcggtaacttacacagggccaaaaactttggtttgccactttggccatctccttatccctttcgcccttacaaagcccagaaatcggaaggctcaggagaaaggttggagaccaatgtgactagagtcaactctaagaattttgagaatttcagccctaggaaaaactgcgaaaagacacggggtgggaagggaaggaacgccgagaggtttgtggggtgccactggagccccagacgcccgcagttgggggcatgcgcggggcagccgtccaggtgcgtggccgcggcggggatagggtgtcccgggccccccgacacccctcattcctcaccgggaccgtagaacttgctgcctttggtcacgtcgaagactttcccattgaccgcgagcaggatgcgcggcgtgcgcgccccgtcgtactggcgcagctgctccaggctgaagtcccgtttcttcatgcgtggtagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgcgtctgtgacgccgcacggcgggggccgtaacggagccggagatgcgggagcgcgtgtgaagcggggatgtggacattaggcccagctgcgcccgatgcctccgctccaggtctgggcccacgctgctcttgggcagtgctcctaatcccggcccgacgcaagctcgcccgcgccctgcctcctcctccgcggtgggagtgtgcgggggtaaggccgcctgtgctcgccctccctgctgtggggcctgcgggagccctggttttccagcgagaattccgtctgctcctagccacgcccgcctcgcgctctcaactagtttgacaggcttctgccgccctgcctgtgaggaaggaatgtggatcctgggaatggctggttccttgtcactttgaacgaacgagggggtgggggacaggtatagacgagctgtggcagcttaggggtgagctacccaacacaaaggagctgactctgggtttaacgtgagcggtagtctagaagagtaagaatgggcttttctcgctccggtcagtttttaggtacttgtcttagagtaaaggggtaggacagtactaccggttaaccataccggtgatcaaaacttaccttgagcggacttatttaggacttgaagaaaggggtgggatgggaaaccagttatgcaactgtacctgcgctgtacacagactctagtgatggcgttagcgaaggggttgagaacagttttctgtaatacattataaaggagctgtgggccataaggtcgccgctctagcttctcaactcatagttaatacttaagtgaacgaatgtggtaatgttccaatgaaaactgtacttagagacactgaactctaatttctgttgtcatgaaatgttatccctttgtttttgagacagggtctcatgtatcccagactggctgtgaacttgatatgtagatgaggatgaccatgaactcctgattcttctacctcctgcttgccagcaagtaaccaactaagctacattctcttggccatccttctgatttttaaatcacttaataacattaaagtcagtttcagccccaaagtaggtacaaaaacaacttgcaagcccagggtttgccaatccctgagaacatttttttttttttcttttgagtcagagctgttatctttaattgaaaataaataagtgaccatataatctttacactgggagaacaggaataaaatcggttgtcacaagcaaacctcagtagtcactgtcagattaagggttagaagtcacagttgctgtgggacttggtaacagaaaacggagatgtcagtgatagaaaaagattgggaagaaacttttttttgagaaacaaatggttgtagcagtgtcaagtatctatatagttgaaacgacgacagtaaaaagaaaggactcctgaggcttcatagaaggccactcatgtcctactattcagaattgggtcgttagctatcactaaagcattaactgacagattgcctttccttacatggctttggggagttcttaggaaaggctgtactgcacatggggcatagtcagtcaccccaggcattatgatatggaaaacctttttcctttctgctgtatacttgttccctaggaaggtggtactgactgagaatcactggcatagatggccaggcctaactttggaactgattatggcacagttttgcttcacttatttggtttagaagagaggaattgaaagcattgtatttcagttgtccctgcttggatggggaatgttggatagttaatattgtctagtgaagcaaaaagttcatgcccttcctaaaataagtgtcttgagttcatataaaccctatctctgtcggggtcctctgagcagggtaccattaaggtaagtctcctgaactggtccaaaagaattcttcctttttttgccctgtcatagtaatctcttccaatttgannnnnnnnnnnnnnnnnnnnnnnnnnnngtgaattctgcagtaattttacatcttgtgatttctcaacttcgttcccacatgaagggactcatcatgtatgttaatttcctttgatcagacatcaatttctggggccaggagcagggaacttagcaaatcagaaaagctgtttgtattcagagatctccatatatccctaagtggcctctgtctttttctatatagataatctgtgagatgtcctctcttaaagtgatctgtttatttctatactagtttatcctgtgatctccatttgctgtgcttattacctactccaagactgcccacactactgtcttattgaatgcccttctggaattgcacctgtccagtattactttccctttctgaggctgtgactgatttttttctttgaatgtctctgcatctcttccctatatcacccattttggctttttattcttaactgttgtatttttgttgttttgaggcaagatctcactgtgaggccaagactgcactcagattcattatgtatgtacctgacgttggcctccaactctttattttcttgttccatcctccctgggctgggtttacagattcctatcaggttattacattatttaaattccttgaatttcaagattcctccttgtacattgttggtcttttcctgatttttgtgtttttgacactgggtttctctgtattgctttggatgctgtcctggcactcactctgaagaccaggctggcctggaactcacagagatccacctgcctctgcctcccgagtgctgggattaaaggcatccaacaccctgcccttttctgattcttttttccctcatttattcttcccttgcccttaccttgtttaggtcatctacattctctgcccgtactttaactttgattacttagcactgtgtgtacttctgatttaccagttatctgttggagattcacctctgcagctctgacttctccccaggagctactaatgctaaccacatattgtgttcacctctacccccagaaattatttgtgttacttccaaagaaaagtttagaatacctatgtatcttactcatgctcttctccttttgccagggtgacaatgttttcattatctattgtcctgtatctaccacttagtaatgttaaacaatcaggtagcttttgttttctctcacggttttgtgggttgaaagctcgaaggacattgtttaattttgctttgaggtttctcgtaaggttctaggcagaagtaattgggaagctcatctaggtttgtggctgagtttttctcttccatagtcttccacagccctcttcacatggcttgtctagaagactagcgtgctggttcaggacttggaaagcaaaaggacagaaacttctaggtgtttctaaatctaaagttgaaaacaacacatttctgttggtgaaagtagttgtaggtctagctgaattttaaaatgagaaaacaagtatcagtgaggagggggttgacagtctccagtgatggttcaaatgatggctgatttcatcattcagagccctagaatcaggatgaagcagaaaagagctgctagctaacacatggcatcatatgaatgaggattacattgatatgtttcaactcgcagatacttgaggttgtgctgctaactttgctgggtagggcattgatataacaatctaacaagacgttgacatatataacatgatatacatattagtagttgggtgttgagcagcatccagttctcacaaatttccaccatgacacctaataaatattacttataaaaataaaccttatttcttaaataagagattctttttcttttaattctttactgtcttaggggaaacatttctttattgttgacaattactgataatatggagaaggaaagttgatccatattcagatgagtgagcttggtacttatgcaactcaccgtcatcctctcctttttccttcctctttggagtcagaatcctacatttcttttttactacttcatatctcatgtttgctagaggattgctcctgctggggaacacccctgtaaacctagtaggatccctgggggaaggaaagctgatttgggagctaaggtcacttccagagcccaagagaacctgatgtttgaactttatttcagagggttcaatgttgaacattataattttggactttaacacaagttggcactgattacttgaactgttacttagaataaagcaatttgatctctcttttttttcctccctgaaaacttaacattgagagagatgttaagtgaaatgagacaaattttgacagttacccaagttttggattttcttctagaaagattatcatggacaagctagggcataattccaatacagcagtagaacaggttatgaactagagctttgggcacaagccgatttaattctgaccaattcagggtctcatgggaagaaagttacactttatcattggtactagaagctgctcaaaaaggtaaagattatagaagcagaaacagggctatcccaattgattgctgacatctccaagtgagataccatatcccaagttgatctcagtggatgaactataaggggtaaggcaatggtcatgtctttgtgggtacactcacctaaaatagtgttttaaaagataggtttcataacccaggctggccttgaatctacattcttcctgctttaactttttaacatacattttaaattgataatatgacatttctttgtcctaagtctttgggaaaaaatgttttgggtataacaaacatgaatattttataattaatattaaaacaagggttatggatccaggtatggtccaccactactataattgtagcacttacgaggtagaggcaggaagaacatgagctcactttattgagtttaagagcagcctgggctatatgaggccctgtcttaaaacaacccccaaacaagaagtgttactgaactgggcgttggtggcacacgcctttaatcccagctctccagaggcagaggcaggcggatctgtgtgagttcgaggccagcctggtctccagagcgagtgttaggataggctccaaatctacacagagaaaccctgtctcaaaaaacaaaaaacaaacaaaaagtgttactgtgttagatacttttctatagctgcaataaagccgtaagatcaagacaacttgtagaaagaaggtttatttggggcttacagttcccctgagggataggaattcaccatcatggcctggagcttggcagcaggcaggcagacatggtgctagagcagcagctggtcattaggaatgtaggagacttccctggtgacacacctcctccaacaaggccttccatcctaatgctttccaaacagttccaccaactggagaccaagtgttcaaacatgagtgtatgggagccattcttatccaaactgccacagacacttaaaattgcacttaataaaatataaactctatagtaatttaatactggtatcattgtcataaaattttatattattgttttgtcttttgaggtggtattttggtttccccaaagaattttctgtttaatgtattttatcactttttgcaataaaagatttttaaaagttttaatttttaaaatgtcctttaaccataagttctaagagttgattgagttattatagttattagtagcatatgataggttatatttatactgtacatgttaaaaataatatgtattttgtgtacattggtgtttagcccacatgtatgtctgtgtgagggtttcatatcccctggaacaggagtttcaacagttgtgagctgctgtgtgggtgctgggaattgaatccgagtcctctggatgagcagccagtgctcttaaccatagagccatctccagcccctggattgtacatttttacaaataattaccaaagagaatttcattggaactctgtctttcagaagcagagacatccgtagatatacactgagctgaaatcgggaatttagttgaagagagggaggaatgaagagcgaaggggtctgtaccaggttggagaaacccacaggaacagttggcctgaacaagggagagcacatcgaccccagatgctgtctgggaggccagtacaagactgatccagacccctgaacatggatgtcaataaggaggcctctgcactccagggagcctctggtggtggattagtatttttccctggtgcaagaagggactttgagagcccatcccatatgaagggttacactctggccctggacacatggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaaaggagggatgggggtgaggggagggagaaggagaagggacttacatgtgaaacaagcttgttccctaactagaactaataaattaaaagttcttaccaccccagttcagctatttatagacaaatacattttttttctaaaatataaaataggaaacagtgttgatggccaattcaggacttcaaaaagtgaataaacatgttcttactaaatatgtaatagtagaaaactcatgacataaatggtagggatgaataataaggtaataagacatgcctacgggccattttgatagaggcatttcctcagtttgtgtcaagttaacaaaaactagccaacaccatggataacaaaatcaaacagctttgtttgggttaagaaatgaatgtagattttaatgtattcagtaactatgttttgattcatggtctggctgtgtagcccagactaactttaaagtggtaatctacctgccttggtttccctagcactcagatgtgcaacaccatgcctacattcagttgcactttgtcagaggtatttctccagttgttcaaagtagtatgttttataaaacacttaaattgcatgcctttttcattaacattgatctattgtgatggaaatctatgattatttttcattcgttcacatcatatagagtatgttgctgaggctgggggaatgagatttgtcattgggatcttcctaaatagtgagcatgtgagtcttgccacagagtaattcccagaatgttgtccacaaatcttgcgtgcttgaactctgagataggtatgtggagcatgacactgtgagttagctatttggatgaagtagggtctcacctccttccacacttcctttggttctttcatgcacattctttgacatcatcaggaaatagtaaaggaaatggctttggacactatgtaactcctgtcttttccacagtatataagaactacaatgcagatcacggttttccatagtgctttcctcttaatagaaatccataaagtaaggaaagaggaaatacaagtttatcttgtgtagctgtttcttcaaagcattccctccttgagaacagaagttcataagattcaggaagtaaaacttacaaggctcaggaagctgctggaagttacaagattcatacagctcttccctgaggttataaaaggagtaaacaattgctgtgaatagaagagacttatcagctgaaaagcctacaagttaagtgaggagctcccaggatgtagcttttctcaaatcagtttagatataaaggtatgttcaatactgccttttgtctttaagtattttatacgtatttcttaggtttgtgtgttgagatacacatagtttattttccaaggaactcttactaaatacatacaaccagaagacttagttcagaacaaatagtcactctatggcattaaacatttcttcaagttccattgtggctaaggtttcacagaggcgaatgactccaggtgcaggagcgattgccagtggttaagagtacttactgctcttgcagaggatggcagtccattctcagcactcatggagggcagatcacaactgcctataactcaaactctagagtatccagcatcctcatccggcttccgtggaaacttgcatatatgtgcactccccatgcacctaaaatatgtataagagttgactctctggaatacaggcttatcactcacgattcttcctgtagtgtaagttacatggctaagccatgctaaaacaaaatacgaccatcatattaaaaaagttataaagcaaaataaagaaatgagttgacagaactaatgtgtctatggatatctaatatttatttgtttattatttttcttctaataaatatattcttttttcatataatatgtcctaattatagttttcccttcctctacttccagttcttctccaccttccttcccctctggatccaattcctttctgtctctcattagaaaagaacaggcttctaagagataaccagacatgacaaactaaaagacaataagatcaagcaaaaactatcctattaaagttggccatgacaacccaacaggagggaaagaatcctaagaacaggcacaagagcctgagactcactcgttctcacagttggatatctaatattttaaggaaatggatatttgcaaatggatacaactttgttttataaacacctgggtcttaagaaaataaaacagttttttttagagtgaaaaaaaccaagagccataatttaagcaaaatagactgctcttagactcctcttgaattaattggtgcagaaaattcacatattttcatgcattggcagaaattctgaatggctttaccttgtcccagcaattggaagttcagacagttgtggaatttgattagaagagacaaaagaccatgatatttatttatttatttacttttattggtttgggttatgatttggctccttgtttcaacacgtgacctccagctagtagtagcattttgggagattgtggattctttaagagataagggaaggtgggttgctggggagcaggccatgaggtttatatctcaacctcatttcctgtcccatctctatttcctgttctgcccaagtgtgagcaagcagcttcacacttgctgacacagctgcaggatgttcctgtcaccatgcctaccctgccaagagggactgtatccctcaaactatgagttaaggtaattctttcttaagttgtcttagccaggtattgtatcacagtgacaagaaaaagcaactacacaaacatcaagttctagtggtctccaggatgttatttaaatttgactaactgattcccgtctattgctgccatactagtagaatccatcagtacttttcatctgaaccacagtaataccctcctgcctgtcctttcggtttctactcttgcctttgtaaaattcattattagctctttaacaattcagtcagattctattacagtgattctcaaccttcctaatgctgtgaccctttaactcagttccccatgttgtggtgacccccagtcataaaattatttttgttgctacctcataactgtaatttcgctgttatgaattgtaatgtaaatatctgatatgcaaactctgtgtaagagtccatcaactccaaaggggtcacgccccacaggtggagaaccactgctctataacttccctgttttatcctgttagcatctctccttttcaagtagaataaaacccaaacttcttatcatagtctacaagatctcttttatattttcttttgttgttcttagactcctttatttgaatactcaaggcccatttctgtctcacagattttgcattttttttctttttttgtagccctcaagttctctaccttaggtttctcattgctgactaggtctcaaattcaagtctcagcacaaatatcatttctcaggaaattctttcccttatgtctaaggaactcacacctttattcctcttactttatgttttgtcatgcttattttttctttgtagcatttagtactacttgaaaaaaaattttttacatgtttttcctcttttgcttcattagttctcagtagagcatgagtttgtgattctctgtcttgttccctgctctatcctaaggcttagaacaaaagtggcatttgatagagattattaaatatttgctgaattaatgaatccaggtcctgatgtgcccacaaaaggcttctcaggagagctttgtgtgagtaatttgccatagctcagagttgtggcctttctgagcacccaagagtctgcttttgcctgcatgtaaaagttgattttctccagggcagaacttatattaactgaggtacttgattgacatataaaatccctatgctgatctctcagttttcagtgagcaatatgtcatgtgaacagacttgcagtgataagatgtaatgaaaaatttctgtctaacatacctaggacaggaaatcaaatcagaatactttttggaaatatgtaatacaagaagggggaattaggtggcttatgtgtttaaggctttaattacttaattaatattatgcttccatagctgttgtgtgttttgtgaggggtactgaagaatcaacaagtaataataccaattaccagtcttgaaggatttaccatttagttggtgtgttagactttttcctaaaagttttgtggtaaatacctggaagtttaaaggaagaaggatttattttggcccatgttgtcttagggtttctgttgttgtgaagagacaccatgaccatggcaactcttaggataaaaacattaattgaggtggcagtatacagtttagaggttcagtccattatcttcatggctgggagcatggcgacgtgcaagctggcatggtgctggagaagtagctgggagcactgtatcttgcaggaaacaggaagtcaactgggtagtatcctgagtgtaaactccccccaaagcccaccctcacaacgacacacttctctaacaaggccatacttatgccaacaaagcttcacctcctcatagtgctacttcctatgagcttatggggaggcaattacattcaaaccaccacacatggtgtcagagatttcatgccatgctctgctggcttgattgatgctaggcttttgataaaggagaatatggcagaaggacatgatgatgcagagatgctcacttcctggcagcaatgaagcatagacccagaggaaccagacattctctccagacacctttagtttctaccatctcccaccaccagatgagatgaacacacgagactatacaggacatttcatacccatagcagacaaatggacaatagatcagtttcaggaatactatggcagggctcaatggggcccctgaggaatgcggttatagattagtagtagaacactttcctcgctcaccagcctctgtggctcaattggacactacgagtgagagggattggattaaggtttgggggattcaggtaagccttccaggaggtggatgctttagctgatggaggaggagttagctaggattgaagacagattgggacaaggaagggagctgtgggcagatgcagctggagtgaaggtctggaacaagagggtataactgtaagttccagggtgctagagtgaagaaattgaggttgtgattgggtgtggcgacagggctacagatagtgctcatggacctcagtttggactttgttcccgtaaagtgcaaggggagataactactggaaggtttccttagggtggggaggcagagttcatccttcagcttgccagatcacagccaacacttcacattccttctgtgaacttcccataaacatctgagtaatgcccatattccttcgagaacacaggatcccgcctttacctatgcccagccttagtgcctgctgctcttcagtaacacctgatacttgagcactgtctgtctatacccaccctacttgcctccaaaagattactagtgtgttctcatcctctcttcctctcctcttcttttctttcctctcttctcctcttctctcttctatctccctccctctcgccctccttccctctctcctctgtctccccctcatctccctcctctcccccattcactttcatcttactgtttttattcattctcctggcagatatcaaacttctgggctcaggcaatctttttgccttagccttttgagaaggagggcttacagcatgcatcattgtagcccggcttcgattatcctttgaaatgacaaaatagcgcatgcatttttgcaacaagccaggcaatacagaaatatggaaataaaaagttaaaacttgggcaggaaagatggctcagtggcaaagagcattcactgctcttgcagaggatccagatttgaccagcatcagtccctcacaaccgcttgtaattacagttgcagaggatgtgatgatgccctttgaactctgtggcacctacatgtacgctcatgcaggcacacacacacacacacacacaaataaaaatataaataggtcttcttttaaggctttttatttcttattgagcagacacactatgctgtcaaaaatataaatatagatgcatatattttaccaaaataaagccttgttattcgatttgagttgtgcctaacaccccaacagagcactgtagacattgtttctgcacctggtggaagccaggtccaatgttttatctcatctaatgcatggcattcatatgcagtgtggactgtggtccccagtagatatagataagatgtgacaaatttgcctaatgattgtgggaacagcaatttgaagttggtctttggctcctgagaatgaaatgtttcctttgccttttgtcgtctcccaaataatacttttacttaaaaaaaaagtgcccagtatttaggttggttccagaatttattaaatcattttccctatttacgaatgttgaggtttctttctttctttttttttttctgaggaggaaagtgtttaattggcttatgcttccacatcactgatcatcattgaaggaagtcaggacaggaactcaaatagaacagaaacctggaggcaggagctgatgcagagggcatgaaggagtgctgcttactggtttgctcctcatggttggctcagcttgcctttttatagagcccaagacaatcagcccagagatagctctacccacaatcactaattaagacaatgccctgcaggcttgtctgcattgaggtttctttttgccactacataaatggtgttgttaagcagttctctaacatgaaacaaggtcagtggacatttaaaaaaattgtgtgtgtgtgtgtgtgtgtgtgtgtgtgtgtgtgtgtgtgtgtctatgtctatgtgtgtatctatgtctgtgtgtgtgtatctatgtctgtgtgtgtgtgtgtatctatatctgtgtgtatctatgtctctctgtgtgtgtatctatgtctgtgtgtgtgtttgcgtggggggggggaaggcacacaccccaacctgaatgtggagatcacagaacaactggaggaagtcgcttcacttctccacagtatgccgtcaagatcggcatactaacatctttatctgctgagccaactcactgaccccagcaacaaacatttaaaaatgtatttgtttattgtgtgtgggcaagaggaaatcttttgggagttggttctctccttttactgcagatttcagggatctaattcaggttctcaggcttgttcaacaaaacactttacccactaagccatctgtgctagttagtgttccttgtccacttgacacaacctagactcacctggaagagagtcttaatgaggaattatccagataagcttggcctgtagacacatcttaggggaattgtcttggttgttaattagaacaggaagaaccagcccatagtgggcagagagaagcagagccgagcacagtgtgcaaacaaggatgcatttatttctttctgctcttgactgtggacgtgatgtgacttgagttcctgtcttgccttccttcgaatgatggactgtaatttggaattgtaagccaagtaaacctttccctgtcccattttgcttttttgcagggtattttatcatggtaacagaaatgaatctaagacaccatctcatcagttcaggcccagggcacacttatttttattagacatggctaaatcaaattctgagcattctatatcatctttgagagcttgtttggagtgctagcaggagagtgaagctgctcaaatgctattgactgaaggacaacctgtttctttcaggtctcctacatccatcctcttagtgctagagcagagattaccacatccttcttacaacactcccaagatgtatggggcagagagttctccttttaccctctcctatctcctatgattcttatattctaacaatacatgttttgatttgtgtctttcctgactactgatgagggtgaggtatgctttggggggtgtctgcatttcctattccatgatttgtctgtctcctgtcaggcttttcttttgagctgtttgttcttgacccttttatagtagcaagtagtttgaacttttattctctccttttctgtggttactggactttttactttaagctctaccatatagaaatatttagtttggtgctagggagtacatagatggttcagtggatgtaagcccttgttgtgcaaacttgaggacctgagtttggattcctagcaactttgtaaaagctggggtacacctataaccctagtgctgggcattgaagggtggagacaggaggaccttaggttttctagccagcctaggtgtaaaaagaaagaaaagctataggttccgtaagagactctgtgtcaggacaatgcaagagtcacagagcagttcagggggacagcctctggagtctccatgtgcctcgtggttgcaagtatccacagatgactcaatcatactacacacactggcacatttgcatacacacacacataacacagagggagagagaggaagagaggaagaggacgtaggcagaaattggtgaattcttatgagacagacctgtcagtctttccctgaacttgatgctttgtgcatctcttcattttaacgattagaacagctggcccggactcccctattcgtgcttttgagacttctctaacttctgtctctgtctctttgaacttaacatccagtctcctggggcatctcttcttcctgggagttgttaattatatcccactagacaaaatcaaagtctgcctagtcttggagccatttgtcacttataaaggtgcactatcatgtttgtgttctctctctcctggcttggggagcagtcaacgtactccttttgttttatggtgggctttttgaaccatctttagtcttggagtctgtaagcttttgtgagatgatttagaaagaggatatgcccttggtacaagactggtggatagcgacgatatgttggtaatgggaggctgtggattggagaatgagtttgactctgtctttgattaccgcagtgtataatcctggagaggttgttagaagcctcagggccctctcccataagccagagtgacaagaatactgctctgaggccactttttgacagttcaggagaaacctgtaggagttaatttagatgtatactcctttttgggcatatttcaagaatgtttttaatgaggtcaaatcttcacaaattaccttggtctatcccttttggcaaagcaaacccttttcatttgctgtcaggccaataaaagaatgatacaatttgttggctataatgactggtatcctttacagattctcaggaatgaactgccaagttcgttactgagatgagaaactcttagtggaaattaagtttggggccattttgcctcagccatggatcaggaccaaggaatgtgtaggttggggatgggcctgtaggttgaatctaacctgtatttcagaggatacttttaaatctacgctttcagttgacaaacaataatagtgtgtatctatagggtacaatgtgatgagatatgcatacattataaaataattatatcaaaccaagtaccatatccacaacttcaatttcgtatatatttttatagtgagaacatttaaaatacattcttttggcaattttgaaacactctgttataattaactatggttaatatggatgataaacatgtcttggttgataaaatattcatatgtaatacgtttcaaaacccttttcttcctgtccagtagaaagtatacccatgaccaacatctccctaccccaacctctgatggccactcttccactcttgagttctgtaagtcattctttttaggattgatacataagtgagtctgtgcaggtttttttgtaagttctctggcttcattcattttgttctaaatggcagaacttccttctatttcgtgacctctagtattttgttgtatatttaccacagtaccttccttccttccttccttccttccttccttccttccttccttccttcctttctttctttcttcctttctttcttttaagacagtttctctgtggctttagaggctgtcctggaactagctcttgtagaccaggctggtctcgaactcacagagatccatctgcctctgctcctgagtgctgggattaaaggcatgtgccaccaacgcccggccttttaccacagtttcttatccactcatcctctcatagaacttaggttgagtccatttctttgttttgttttgtttttttgagacagggcttctctgtgtagcttgcctgtcctggaactcactctgtagaccaggttggcctcaaactcacagagatccatctgcctctgcctcctgagtgctgggattaaaggtgtgccactaccatctggcgagtccatttctttgctgttgtggatattgctgtatggaatgtaggaatgaaaataactcttcagtatattgatttcatctatttaggataaacacctaggagtagaatttctggatcatatggtattcttgttttatttgtatgaggagccttcataccgttctgtatcacatatatatgccagagcagagggaaatatcagcttatggtatttatcgaatcctaagctatctaaatggtatcttgccaggatgaaatggtttagtacccccattattggatttgatattcagtctacttatctccctcctcttgttcaacccaccctttttacactgacacttattggtctgtttggagactgagctcatgtatcctggaatgaccttcaatttactaagtagcggaggctaaactgaactcctgaccctcttgcctacaacttactccccagatagtccccccttccttgtccaaagttagtgtgtttaatagatgttacaggagacccttgagtctgtctttcaaagaaaatagaggaaggtatcaccctacatatggtcaaagaaaatgttgtggacagagaaatcaaccttcttgaaatagactggcaggtttcctctgatcatccctttataaaccctcagatgattgcttctctgaaactggctgttttagtcagacataccagcacatacctgggattccagtactcaggaggcagaggcagggttataggaatgcgaagctagtgttaggctaggattaggaggagttagtgggagcaatggaggtgaatttgatcaaaatacattgtgtcaaattctcaaatcattaataaaatacttttaaaagcaaaatgtaaaaagataggaaatagttttttattttaatttttatttatgttcatgttttgggtgtttgtattgggtatttcacatggatgcaggtacccacagaggccagaagaatgtgttggatcccttggaactggaatcacaagcagttgtaagatacctggttactgggaactaaatttgcataccttggaagcaggacatactcctacctgctgagccatctctgcagctcaaaaataggttttgactaccgactaccatattcaagttttgaattctacccagtgccagttctccttccttttgcctcctgtgagcaccccagcaccagtcacccctcttgaacattgtctcactctgttgatgacccccgactacacagtgtctctgctctcacttctctagcctaatttgctactcatggaactcagtgggaccctgattccagagctgttgcttgtatggctggcttgtggcccaactgtagttgaactgaataccttgactcaggctatggaggtgctgacagaagagtggctatctgatgagtgacactttgttttttttgagacaggaatccatatagcctgggctgtctttaatttgctgtatagccaaagataacctagaatttctgatccttgtgcttccacctcttgagtgttgagataacaggtgtcctagcacaaggttacatggtgctttgtacattcttctaactgtgctagattccccacctcaccctatgcagcaaatttgggtgctaagcaaagtttagcattatgttagagaagccataacatagtactctcctcagcttagcatgaagtgtaacgaacaaatatacctctaaagagctccaactgtcaaatattcctctgataagtgttgggatgggagctctggaatggacatcatgggtgctgggaattgaacccaggtcccctggaagaccgccccccaccaagactcttaatagcgcttttaactgcctcactatctctccagttcctcacctaggcttttgaaaaggctcttcttnnnnnnnnnnnnnnnnnnnnnnnnnnnnnnnnnnnnnnnnnnnnnnnnnnnngattgttcttggttgcctagctttgtacagtagagatttcatataaaatgtttagtcttctctttcttcatcttcactctgtaacatcccctcccccatgatggctgtgcttatgtgcatattgagagagaacagaaatacagagacacagacctggtaaccacggaagcatcttcgttcaggtctgctataagtactaggatgaggaaatgctgaaagtctcctggagaaccttgcttggttagggatcagcttcagttttctctctcttttatcactagggtaaggggtggatttcagccttgtcttggatgctttcccactttatttaacttagttcagaaattacacagtaattctatataacatgccatttcctttgccagtaacaacagttttatctccattcttcataaccatttttattgttttcctatagtaagacaatcaaatgagaattgtaaatattttgtggccattttctcttgacaaaacagttccctggagtatctccccccacctctgatatggtttaggggagagtaatcatatttgtttaggatccaacttcacccaacagaaatattgagtgtaaaagattcttcagctcatttaacaatgcagcaggtattttacattctactcggtgaccacaatctctctaatataactcagagttattgagcagaaagtaaagcttacacatatttggagttatctatctattaccaatattatgttgtaaaacaggataattatagcaatgataattatataaaaatggtggggtaaataatattagtttgggcatgagactcatacatgttttaactctggcatcttccctaggcatctcctactacaactttctttttagatttcttttcttttcttttcttttcccggttttttgagacagggttcctctgtgtagctttggagcctatcctggcactcactctggagaccaggctggcctcgaactcacagagatccatctgcccctgcctcccgagtgctgggattaaaggcgtgcgccaccaatgcccggctagattttatttctttttaaatttttttttgtgtgtatgtgactacatatattcatgtgtgtgtagatgctcacagaaggcagaagagggtgttggatcccctggatttggagttacaggtagttgtgaagtgcccaacatgggtgctaggaagtgaacttaggtcacttccttactcttataaatactctcaaccattaggtcatctctccagcccctgtttcattatgttataagttcttactccttgccagggagtctactgggtgtggggttgtatagataacaatgctctggaccttgttttagaaacatatcctgtccttgttgagagctagctggtaaagagttatgggcacttggcatagaggcacactacagcatctggggaagcagggggatagaggttttggggccagcctgggctacacaatgagttccagactagcctgggctacagagagatactctgtatccagatagttgaggctgagtggagttgctggccacagtgtcctgcagaagatgatcccagactctctgtatgtagcaagaagtcttggatatgaacatcaagctgtggaatttggaacataaaccccaaagttgccctctgaccttcacatgagcatatacccacccccacactccactaataataaattaacacaacaattctggatgagggtttagagaattctgactcagatggcagattttagaaaaaaaatcattcctttcttttttcattagatataaaggttgactcagtaattaacttcaacataagagtatcaaccttccgactaaaatacagaagtttctgtttaatctaaaccctctttccttcaatagcagcctgatactcacagtactcctgccttctccccctgagtgctgtgattacagatgtgcaccacaccaagcaagcaatgtaaaatttttcaagtgggaaataatgttcaaagttgtcacaagatgggccctgtcatcctttggaaagttcactgaaaaaaaagatgggggaaggaagaaatggaaccatctatgatccttagtccagattccaagccttccatttttaagcttttggaggaacatgaaagttcagttttcccacactagcatgttccagagcacctttctttctttctttctttctttctttctttctttctttctttctgatgtctctgttacaaagcctctgaagtggccaggtgtgtgtcttaataagtgcttgtctaatatgtggtacctgcagtcctgaccctcggggagtggaggtgctcacatcagagttcaaggtcattctctgctacatagcaagtttgagagtgatctggggtacatgacacccttttgttgttgtctgtttcttttaagactttagaggtagctatcctttggccagctgtggtcacaggaaaatagcaggagatagtaggagctctgccatggctggctgggacagagctgctggaggatttgtaggcagcacaactgtctgtccacatacaatgacagagcagcaaggctctgtcctggtgatttttttgggatctctgtcttccctttttctttgccatttctgttgcttaatcatgcctgtcctcacagtcacgggtctggactccagcctttccctctgatatcatatccactcccatagcaggagcctcatggcctctcagtgataagtctcctaagtcagccatcaggcactcttctcacttatcaaaaatgtaaaagacctatgaggccctgagagggccgtgccagctgcatctctgccccattgcctgccctgctgtcttggggagaaggtgccagtttccagacgccgtggcttcagcctcaggcataaagatgggggcagagtctgaagccacctgtagcaagtgcccaggcagttgatctcgctgttcctcttggcttctaggaccctcaactttaatcttttcctccttttatttcagagacttatgtggcatattttacattttccaaaatgcctggtgcatttattttttcatgccataaagtattttttccaggctgggaatatagcaacatttccatagtttgaaattgtttcaaagagcttttaaaagaataaagatgctagaagttttattgaggcatgaatgttaatttacataaatgtaaattactacttgtatagttcttgaaatcctaaggtcttctttttcaacttagtatttttagttaaatattcccatgtacctatttggtcatatactgtgttagatagctttctgttactgtaacaaaatccttgaggcaaatttttaaaaatggagagcttggacttgaggatgtgacttaagtggtagagagcttgcttagaacacacagagtgctgtcaaaaataaattaatttttcctggaattataattcattatatctgtgaatgagataaagtttctaacaaataattatgttggcaaatgataacagcttcatgagtaaaagcattaataaataacccaattttgtcattaagaaatattttttaaaacaaaatagtaatgaatgaatagcatcagcaaatgctaatttatcacacacatattaaaacaacaaggagggaaataaaaacagtaaaacttcaccgagaattctatggtcgtgtatgtgtgtttcctggatgaggctgcatacaggttaggggagactgaattcactgtgtgctgtccttcacactagcactagctcctcgtgttgtatttttctgcctttaaccagtttcagtttatgatttcagaactcagacattttggtattagtatgatttttcttctttttggtggtggtggtgatggaggggctgtgattttacctcctcagatcgaggattcccacgctaagctgtatgacactggattgtcaccgtgtgttggagagctgttgggtattactaacccttcaggcacacaaattgattcccatttaatcttgcataatccaagaaacaatagacatgactcgggctttcatcttctaggtttgatggctttaggcagctggtggagagaaagaactgaagagtcatcatggtggagagagaatgactgacaatttactgctttaataaactgtcccaatgacacttgcatcttaagacaatgattgctaaattaaacaagcacatttaagcataagctgccaggcagttttagaggagactgaatagtaatctggggcaaagtgctcttgaatcataccaccagggccagagttcacagtgttaccagaggtcagctgctgttggaaatgggttgatatggcgttcagccaaaaagccagggaaatgggcaagggcatctctttctccctgccctttgcctctccagaagggcactgtctgggcacactctgcagggtgagttttcaggagaccaatagagtcacctgacaatacagggtccaccagagcagaggggctgtctgtctctgagcagagcagggactgtgcagctcagtcaggtgtcttgtgttttcttgattccagactactgactggtagaccttcgacacaggctcttatcactatgtgtaaaggtgaaaaattgatttgctcaagtggaagaaaaagtggtactttattccttcttggttgaaagttgaaagtcttgtcttctcatgccacgatgtctttcgagacagggtttctctgttttgctttggagcctgtcctggcactcgttctgtagaccaggctggccttgaactcacagagatccacatgcctctgcatcccaagtgctgggattaaaggtgtgtgccaccaaggtctggcaggaggctgtgttctaagcaatgaaaatcttttgctgaatgtcagagaataacagagcaagcaatggccccatcccccacaagtctagaaacaaagcttccgtattcatcaaacaggaattttatttgagtatacatgtatgtattcgtgtgtatacagatacacctatctgtggaggccatagaccaacctcaggtgtcatttcttaggtgctgcctaccatttattcattatttatttgagatggggtctctcactgaacctgaagcttccagatatggctggccactgaaccccagggatatgcctgtctttgcttctctgctactgggattgtaagcatgtgcccctacaactggccgttaaaaaaaaatgtgttcttagagctatcttcccagcctaagcagcatatttggctatgttctggttttgttctttaccatcttcagtggcagcacaaggctgtggctctcttgaattttattcttcattcctccccccacccattaaatacctctcatattacataaaactgagaaatcttttttataattttagcctatttttatttcatggacatttgtgttttgcctacatgtgtgtctgtgtgaaggtatcggatccccttgaaattggaggcagttatgagctgccatctgggtgctgagaattgaacccaggtcctctggaagggcatccatcttaactgctgagtcatctctctagccttgaaactgagaaatcttactaacagtgttttgatgaggcttgggtgagatcctccagcctttctatttaggacctgtgatggaatactttaagagtgaggacccattctcctgagcacgagagacactgtgctttgagtcacttctctgagttaggctgtgtggtttgagtattcgtccattgaactaaatgatgtaagttgccattttattacataatagtaaaagtttatcagtgctaatggaacttcctgtgtgacaggttctaagtgctttgaacacctgctatcaagttctcagaacaccttcagggaatgttgtacctttatgccaattttagatgggaagctaaatcatgaggcatttggataacttctgtagtctctccaatgatgctgctaaaccaacatgtccggcgacataatgccatattttcatgtgtaaccacagaatacagcctccctaagaacaaataaagtttggaaggatacatggtaacctgggaaaacaggctctgtctagaattatgggaacggagatgggaggaagaacttatttatgccatttgaacttcttgtaatgataatagatttatatgttagttaaaataagtcttttttaattaaagtggttaaagtcttaagttgggttcgtaatttccacagtatcacaactacttaaaaattatctggacatgagattggggaaggacatatttggaggatggtcagggagaatgggagagggagttgagggtgggtagggtcatgatatattgtgtacctgtatgaaattgtcaaggaataaatagaagatattaaaatagaaatcatcattagatcctaaaggctggagtttagaaatcaccaaatattaagccccttatttttcagttgaggaacctgaggttacaccacttgctgaagcccatgggatgagtattgagggagctgactgtcagtgcccaattgtgagttcttcagctgtttgtgtttgttttgagattaccttagctagaataacttgtacagatcttaagtgtgcagtttgaggatttcagcaaaggcatatacataccaacataaccccctggaggccaaggtgaaggtggagatcacagcactgttgcatgttcctctataataggaagctttaaaacattgcctttgttcatgagtgtgtgttggtaagaattcaagagcttgcatttcctcatgcattcacacatttcatagttcccagaggaggtccaccttagtgtagatgtttccttaaaagcaggatttcacaatgtcctgtgctcttgttcttctcaaaccaattcctaattgctggaatggctaattactgttctatgtttgtaagcattaaaacacgttgccctttacttgacataactatcattacatcacaaaattattctttagtcatttatttgaaactcaaatcccccagacacactcatagtcaaaacacatctttttcttttttaactaagcggtttctacatcaaaatcttagaaattttgtaagaataagatatttattaaaaccaggcaggtttggcttgctgggttttccttttcatggacaaagctttccagtggacttggtaataatctaacagcaataggtcatcagatgtctatttgagtatttttttgttttcctcctggggtgcagtgagtcacagccttccagtgcaactcaactgtgcccccccccccagagcattcttctctttctctgcttagtttgttcctggggtatgatgatgaggagagagagagagagagagagagagagagagagagagagagacagagagacacacagagagacacacagagagagacacacagaaagagagagagtctgtgtgtctgtgtctgtgtgtatgtctgtgtcttgcctgtatctgtctatctgtctgagagttatgagttggcagccatgcagcctagtttcagaccagtttatgagtgcttgtccaatgggtctccagttgaagcaaagcccacagggacggtgtcacctggtaaggactgttgggatggcacagtctgcatgctcttttctttctcataatattgatgattctcttgatggtttttagtgtcacacatgggacagatgtgatcattcccggaaacccatctttctcaaatatttcccctaaaattccttgggagctgatgcttctcaggtttctggtctggggatgccagctgccactccagaccctgggagctgtcctggtatagtgctcacaggattggaggcaattcacccatatttctgcaaatatgttttgaatgagattgttgttctttcatgtctgcctttgtcaatcaccttttagttttgtagacaggatgtatctggctttatatttgaccaagctagcaaaatgataagtgttggtttttgtttaaaaggtgttttgaaataaaagttgggaaaaacgtatttgacatatttgtttttgctggaggttaactttggaggtgagaaaaacatgtttgttagcatggaaataatgcttgttctgaagtataaagatggcttgagctatgtgggaccgaccacttgtttgaaactcatctagtggtcagaccctacttcatttctttgcaccgatgccctgtccccatctcagggcaacctggctgtagtgggaccacaatagctttggtctgtcaatagcactaatgaggatgatggtgatgaatgaagtcaactctacgtttataagcttgggaaatgttctctggcatgagcactccttaatccatacacattctgacatctatgacataatatagtcttttagatcttgttctacaaaaattactcaatgacttctaggggatattcccaaagaaacagagtagttttaatacacacattcataacaaactagaaatagcaagcaggaagattaaatgatggagaacttactaagtatggataatatatgatgaaggttggatctagagtatcctgcaaagttctacgtattgtacttggtccccagcctgtgaagatactcagtgactcaacctttaagaggcgatgctgtggagaatgttttaggttgggtccagaaaggggcatgtctttgaaggggtttgtgagatcttggtttatttctccttctctttttgtgcctagctgtaaggtgaccttgccttcttagtttcatgaaccccaccatgattggttgccttactgtgtgcttaaaacagtggcccagtcaagggctgatacacccaaagccacgaaccaaaataagcctcactatgagagagagagagagagagagagagagagagagagagagagagtgtgtgtgtgtgtgtgtttttcttccggatggctgtccatcttgttttttgagatgatgtccctcactgggatccagggctcactgataaagctagactggttcaccagtcagctccagagatctgtctcctcctcccagcactgagattgtaagtacatgctaccaccctaacttttcatgggacttgaactctatgaattttctcgccatcctcccaacccccttgttttgttttgtgagacaaagtctcatgtctcatgtatcccagccagccatgtctacacaaaaccttgtctcaaagaaaaataaaataaaatcagaccagtgtcgtcctggttagttttaattgtcaacttgacacagtctagggtcagctaagaggagaaaccttgattgagcaattgcttagattatctaacggcatatgtgagtgattgtcctgattattaattgatatagggggatccagtcctcaagcaggtggtatttcagttgtataaaaacagctaagtatgagccagtgagtaagccttcatggttcttctgtactttcttgactgtgagtgagttccctcatcagagagaatgctgcatggaatagcaagcagttctgccttcgggttcttgccatgaattccttacctgactgctctcaatgatggactgtgatgtggaagtgtaagatgaaataaacccctttcctaaagttgcctttggccagagtgttttatgacagaaaagatgaaacaagtgcagcttggtacttatctatgctgactggttccaggatagcaacacatttaaagaatacaaggcagacattttctacttcaggtttggttttatgtgatgattccttacaactgttttcaggcaaagcatgtctggccatgcagactgcctgttcttcattggctctactgatgcttatcatttgtgagcgtgctgtctgcactgtccaccacgttgtctgaggcaagaggagtaaaaagcatgtaaagtccccacccctcctcttactctctcctacacttagcttgtaccttaattattattgaaagctacatttcccaagacccattgacatattcctcagataagccaggaccctcaagttcctttactgagtctgcccaccccatcaccaaatcccttagtttcatatctcaaggtaagtcccccttctagtctgtatgcctctgtgtctatcactagatttaatatcttcattttagacttcccagagcactcttacttttccctggggcacacagtaactttgttcatgtagttatttacatacctctcttatcctaggtaataggtactgcatgcctggagagcatgtatggtgtcttaattacctccccatcttcacaagcccccagagatgatgaatggggtcatgatctgtgtttattcacaaagtgtgtatttacttttactacttcccacttctgctgggctcgttgaatacctgactgtgtattttaagaattcctcagcttcagctgctcaacatccctatgcctcctgtttccggtgttgctagtttgcccctgaagtaggaatggaaactctctagagtgtctgtcattgctgcattcttagagcaggtgttaagaaaagtgttgttgagtgaacaagttacttccttgctgtgatttggatgtcgtgtttctagctagagcaccaagccagcttcccgttgctttgacaagaagttatgagaggtctgcacttcctctgggacactcctttaacatccattaaggataattccatgtgtagtggtggagagtacatacttccctcaagattcctctgttccccgggcttactaaactgtaagtgcaacctgccaaaaatcagtggtgttaggatccaaggttactaatttgttcagatactattaatttattctgccaagacaaataagaacaagcattaatttagtttgcaagtttaacaaacaatttggaaggatccaaattctgagtaggtcaatcaagtcttatgctattactaatttctaagtacatcaaggaaagatatccaagaagatggcagagatacttgttacattttatggggactatgtaaaacacatagtctatcttttacaaaagtgtaatttttatgtttttgaaatcaatgaaataacatcattctttataacgggactcccctttagaatattaactggtctattattatttctcatgtgtatctttgtgcacatgttcaaatgcatgtagagatacatgtacatgattgtgtgtatgcattgtagagatacaggtgtgtgtgtgtgtgtgtgtgtgtgtgtgtgtgtgtgtgtgtgtgtgtgtgcacagaggtacatgtatgcttgtgaatgtatgcataagcatgtggaggtcagaagtctgtgccagacatcttcctcttttccacctaatttttgaaacagggtctgttcagtgatttggtaaggttgtctgaggaagccccagaaatccacctgtctccattcttccatagatgtgcactgctgtccccaggggtgctagggatctgaactcgggtcctcatgcttgcatggggacttttctgactgagccacctccccagccctatcataactttaaaaaacattttaaaaaatcttaacatagtttcaggttaccataaaggttgtaaagataatttaagagaacttcagaataccatcacccagtttccctaaagccttcactattgtgtgtgtttatagcaagttcgaagatgacactggtaaagcatcagtaagagcaatcctttattatgattttaccagctttcatctaatgcttcccatttggctccagatcccatacagaacatcaagtgctcatcacttgatttggatgttgaattgtggcagtgttgggaaatgggacctttagggcatgagggccatgaatggggttctcttgggatgggttcattacctcccatttccttctgccctctctttgccactctgccatgtattccctgccatttggtgacacagcatgaagatcctcctgagattctggcgccttgatgctgcacttcatgactctgcatctgtgaatcaatagattggtattcactataaattgtctggctgcctgagcagttcaaattgtcatgtgtccacagccccttctggtctctggccattaactaaatttccttcttctttgataactgtgttggttttgagaactaccaattggtgtatttgcagagaattgtccactttagacttcatgtttctcttatgaggttgtaagtttttggaaagtagatcacggtggtattagtgccattctgattacatcataatcttatgattcatggacatgacacatcagaagaacatgtaaatgacctattttgattgttctttatgggagatttaaacattttccacacttgtttattcatccacttatttacatcagcataggttcttagatatttattttataattatgatccaatattatgttacttattttattgctcaaagtgtttcagtgttagccacagagagctcatccagttggctccagttatctttttggtatgctcccaacactttatttttcagaaattactcactttccactagtataaggatatgaggatcccaggtctagctggtttgagagagatcatatgatgtagtcagagctccctcagctctgtatcccagatccatttctttctttgtgctggctcctttatggactctgcatgtgtgggcaaaagtgtgggttttctgtgacagcaaaccctacatacctgtaggagcaaattctgcagtgtgaatgggcaggccgaggacaacaaggtatatacagaaatgcaggttcatattgccaggtactacagttttcacttttatgttttaagattatgtatatatgtgggggctagggagatggcttagcagttgagagcactggctgttcttcccaagttcatttcccagcaccaacacattctataaccatctgtagctccagttctgggagatttatggcctcttctggactctgtgggcacctgcacacaagggctgcatatacattattgcaggcaagatagtcataaacaaaacctaaaaataaatgagtccttaaaaattatgtattcaagcagtgtctgtatgtagatttgttcacgagagtgcagtgcctcatggatcagaaaggggtttcagatttcctggtgctggagtcacaggcagttgtgagctgcctagaatgggtgctgggaacctaaccatagtcctctgcaagaacagtgtgaccttttaactgctgtaccatctttccagaggtatcctgttcacacctttaaaaaggaatctaggacagggaaactaagatttttatatattggcaactaattaaattaaacaacaacactgttcatacgaggggaatgttatatcatgtacaataaccctgccttttgccatctaaggccattctctggctgcccttaccaggacacatacctgcagaaggtagctccttgagtattatcaggatatatttgctgtttttgcaaacaggtctcactgaaactagtaatgaaatctatactgtacttatcctatgacagacactcccaagcaatgtatatgtctcttcttattgctacaacagacccatgatgctgttagtgtcactagttttagcattctagccttcctatggatgaagatacacaacagagaagcaatggatggctctcgatgtcacacagctggagggaacaaagggaggatagatacccagcagtctgtctgtcattctcagtcttcatctctgtactgtgttgctttacagggctatagctagacacagttgagatctcaaaaaggtcacaaaactcaatcacaaagtatgttaaacttagtattgcggtgtgtgtgtgtgtgtgtgtatgtgtatgtgtgtgtgaaggctcacatatgtgtgggtgtatgtgtggaggtcagaggctaacctggatgttactcaccaggccttgttttttgcgacagggtctcttgctgacttggaactggtcaaataggctagactgaccagccagtgggcatcagggatcactgtcttcatgtccccagtgctgagcttacaatcctatgccaccacacatttcttgtttttgtttttgtttttttaaatgtggatactttgtatcaaattcagatctcatgttgatgcaacaagcacatccttgactaaactttccctctttacttccccctttaagattcagagatggaggttgaaagcaaggaatgactttgacaaattttcaaggactgtcagtggctaagctggagcaagttcaaagcctcctgttgtaccatgtagcttctggggccttgataactacaaagaggagaagttcatgtggcttttttttgaagtatcctaagtcctgatcctgggcaagctgtcctgctggtgctgtttctgagttgagatggtcctctcttaaatacaatctatttggaagcaacaatatctccttgtgtttttaaccagagaagataattacaaaaatgattttcctcagaatttatcagtaatttcattcatgagctcaggcatcagagtgattccagggaggagcccaaggggcagggagaatattttgcagctgtgataaacatctgcctttcagggtctctctgtcaatagtttagagaaatggcatcaagaagccctgaaagtggcattttgtgtacacagacaagtaggtataatgaacagtttcaaaacccccaaattacagcatataatttcttagagatatgtacatgtgaatttaataggttgtacagatggtcttttataacaaagaatattctaagtcctgtggggatataaatataataagctataatctctgtctttatggagcttactgcataggagagaagacagatagatgtctttaattacaataatataaaataagaggaattactaagaaaagaaagaaagacagatcaaatccaactcagaaaccagaggaggcttccaagctttgaggcagaccttgaaggctggccaggtttcagtagctatagttgggcatggaagctatatagacagaggaagcacagagtagacacagagatgagaaactcagggtgtgtttagaaaacacatagtagcaagtctggtcacactgtggagtgctctgattgccagtttagggagcctactctgttcattgagcaaaagactatgcatactcaaggcttttgagcaggcaagggacatgaccaggctgttgagaaaactttgcagaattgaaggaagagaacacaggcaatgttgtggggctcttgggaaaagccagtgtcgggcagggcaataggcctggtagtgagagtaggaaagacattggaggacattctggatgtgatgtttgagatatgggaaggggtgaaaaacaacttaatgatctctgaagttccatgcttacatatctagaaaaatgtacttatgcnnnnnnnnnnnnnnnnagaagaactgccttgagacatatcaggagttataaacgattgaaattgaagagtcaaatagttgtcaaaggagaaagtacttgtagacctggcttcccatgcaagcatagcttacagattgacatttgtgtggaaaatagaaccaacatgtactatacatggttatttactgatttttagataaatttctttatatgacatagaactgcataatgccatcatgaaactgagacccagagaagctgtttgtagatttcccatggttcattcacctcatggcccatgtatgtgacctacttactgtaggtgacatcccattgcacaatgtaacaaaagctaggttgaacctgtctttgaatctaaaaccttggaatgtgagtaaatgaggaatagcttagatttacaggagaggaaactccacttgaaaagattaggctgcaatgttggaaaacactaacatcgaagagctggttcagggaaaggagaaaggcccaaagaatgcatgtaaggtgcaaatggagagcctgagaggatgaagagagcaagggagtttccaaagaggagtgctataatgatctgggttgttccaccaaacactgtgttaaaggcttagttcccagcaagtcactattggaaggtggtgaaaacttcaggacgtggggcctagtcagacctttggggtcattgagattatccttgaagaagattccacctcattggttactttttcttagtgactggtccttctttgtcacacactcctgcctcaccataagtccaaagggactggaccaaaaaccatgttttagatcttatcaaactcagttaaatatcttttctgcttttaggttgactgtctcagatattttgttacagtaaatgaaaggtgaccaaatgcaaggaatggcaagtaggatgtaaaagaagaaacttctatcttgccaatagcatcgtgtgtcccggaaacatcaagaacatgggaatcaagcagaagaagcatctcaattcggtgctgagttaattagatgggttccagaaaagtagggagaaaatagaataaacatgatagtgttagagaatccagaagttgtgatattaaggactaggcaggtgaagaaatggagatattgggcagagctagtgtgctaaataacaagaaagagttgcagtggtcaatgagatgggaataagaaggaggatgggactcatggggatggtgaatttgtttgacagttggactagctggctatagatgcagatcagtacttatagttataagaccaaacatggtgttgatatgcagagatgaaagcctttcctaatgtacatctttagtagacattgtccacctgtatttttggggaagagattgctcacaagcaaaattgtccttcttgacaattgcttgtgttgctgagtaagttggtaatgggtgttcccaatcttgttttgttctttgttgttaaatttctttacctctccatgtgtcttgtgtgctatcaggtagcattcattagggtgtcccttgcctcctcttcttcctggcaccagccccgtgtcctcagtggatgctacatagatgcctctgcctggagtccaggcctcatgtggtgctatcacaggactagttgtaaccccatactgaccaccagtcatatcagcatatcactgtcccaagaggggacattggcttcagtctccttcactaatggtctattggtagcacaggtcatccacactcatacttggctgcacagctctgatttgggattatattttgggattatagctcagaagagaggggagtgacagtggtaagaatgagaatttggccagattgaaggatgtagtcttcgagggggaactaaatctctagttggaatcttagtaatggggcagagtggatgacagaaaaatctaaggatggttactaatggaggagaaggtagagatttgttggattgaagagggggaagggcggtgtcctgacaggcctatcattagtatgtatggtcattttctcaagatgatggaaaaggaagacccagggacattgatgtaggcctgggcatagaggaagacagcctgctcctaaagcatccatggaagatgcttctgacctacagatgacagagaaaagaagccgttgatagtgtggaaatcaggtgcctttatcctgaagtgggagaagttattaaagttttttttaattcgtgtgtgtgtgtgtgtgtgtgtgtgtgtgtgtgtgtgtggagagagagagagagacagaggagagaagaggggaagggaggggagggtagaaagaaagagaagagagaaggttgagagaagaccttggagttcactggaatgcctgaggttttagtcctgtgtgagctcaaaggtacatctaaacccaacctgcatatgtacagctgaagtatgccctgcgtgggaagtgttgtgggatggtgctactgtacaatgcccaagatactgactttggatcaagtaactaaaaaacaatgagcctgaaaaggtcaggagaagtgggtgtggttttttctttcctattttaaatggaacaaattccatcacgtatgaatattgttttaaaagccatggtggctgtataaaaacagttctgtacactgggtgaataattttcactttttggtaatttaacattctttgaagtgctgttaaatttaaaagcacccctccacttgccttggatatttgctacaccagtattaaccatcttatgtgtgcattattcaagttcagtttttatattagctttttaggttagcatacaagataatgaaattctttgtgttttcaggcatgtacgccattatactctattctaattccttcccctcctctcttgcccttctctcttcctactctgatcctctcctctcctgctggtttcttttctattcccacttatcccccacatgcaatttctcgcatcctttaacatctcctttaacatctattcctcccctcttacgacccactttctagttttgtggcctctaagcacacatgtgtatactttcatatctaggctccacatgtaagcataaatgtgcatttgtttttctgagtctaggttattttgcttagatattattttaattaaatgttttccacttgcatccattttcctgaaaatgccatggtctcattttcttctttattccattgtgtctatatattacctttctttgtccagtcgtctgctgatggacatctaggttggttccatctcctagctgttgtgaataatacagccaggtcatgatgccaatagccaaccaacttttcatataaacccctttctttgtaattgtggaccttctatggttgtcagtgaataagctggtgtttgtgaagttgatactacaccggtattggacaaaagaccagccttaaccttatatttgtttatagaatgatccgagcaatccacttaaccctccttagcttcagtactttctctgtcattgaggatgaaaacagcatcaccccagacattgtgtgtgaggatgaagagaaggcatttggctttaggaaacagtcctgtgagtttgcaataaccacgattctcctccctggggagctgataatgcatcagagtttgagaacatgtggtctagactatgtttgctttctcagctgactctctgagatgaacaaagaacaaaggcacagtgcttgcataaaaggaaagtagaggacatcttatgggtcactgagaggtaaactcacaaggggaattgaaagagagggcactgtaggtagaaatcctcaacactccacagccaatgactccttgagctgctacaatccaagggcaggtctccctcccttctcctcctctctcacctaccacctctctctccccactctcactttacagaaagactgtttgtgttccttctcattatagagacattgagagcatgacaaggttcagcttctattaaatctgatttttggattagagctctgattttgccttcaaaggatcttctaccctaagtctttaaagagcaaatgtgatacagatgttacagctagtctgtagtggcttccagctcttcctttaggcccactcttctcaaatctatgtatgtctgcacactgtagtaatctctgggatatagaagttggggaattagaaacagcttcaatcttgctgattaatttctaagtaagattatccttctcataagattatagaaatggactcttttcccaggtttctcctaagtggaaggtatttcccccctcaactcagttgccttggaaactgtaggtgaaacaggtgtctttttttttttttattagttctagttagggaacaagcttatttcaagtcccttctccctctccttcccctcacccccaaccctcttcccccaccccttttctttttttgtttatctttctctgcctccttattgacatccatgttcaggggtctggatcagtcttgtactggcctcccggacagcgtctggggtcgatgtgctctcccttgttcaggccaactgtccatagaaacaaaaaagacacctgttgctcaaagaaacaggtgtcttttttgtttctgtggatccttacaaaccatctgtccttttaactttgaaagccctgagctcttgtctttagactttaccatctaatatttttatcaatagttcccatctaaaacctctttcctatctctcatttttatttgttaactctatcatctggtgtgctgtgtttatttccttctttattcctatattcaatctggtcagttgtttctgatccatccaacaacctggtattataatattttgagtttttctctttttttgcagatttttttatttgaattagaaacaagattgttttacatgacaatcccagttcccttctccctcctgtcttcccctaccaccccctgcaactaaaaccctacctatcacatatcctttctgctccccctggatggtgaggccttccatagggagtcaccatagtctatcgtatcctttgggatagggcctaggcccaccccagtgtgtcttggctcaggaagtattcctctatgtggaatgggctcccaaagtccacacctatgctagggataaggactgaactactacaggaggtaccgtagatttctgaggtttcctcactgaaacccatgttcctggggtctggatgagtcctatgctggtatcccagctatcagcctggggagcaagagttccccgatgttcaggtcagctgtttctgtgggtttcacaagcctggtatggactcctttgctcttcacttgcccttgtctgtatctggattccagttcagttcagtgattagttgtgggtgtctgcttctacttccaccagctgctggatgaagactatacgatgtcatatgaattaatcatcaatctcattatcataagagggcatttaaagtagcctctcctctgttgcttagattgttagctgatgtcatctttgtagatctccagacatttccctagtgcctgatttctctgtaaacctaaaatgtctccctctattatggtatctatttttgagtttttctgttgcaataatttcttctgtcccattttatctaaacactgccacccccattggccacaccacagcattcttgttatcacagagaccctcacatccttcagaatccctctattgaagtcatcgccatactatttggtagtatatgtagagcctcagtctcattcctaccccatcagaactttgacactttagggcactttgggggctgaatgaacctaaaattgactctaccaatggttctctactttcctcaatatcatgttgtcatttatctccttgtccggaaacctccccccatttatctcatatatatgtctgaacctgggatatacagtgtgtatggggggtggtcttagggaagtggctcatcacagggaactccccacaaagcttagttgctcccttttctttagctacatgtgagaaactgatgaaattcatatgaaattcatatagagaattcacatgactgttttctggactttcccagttttctactctaaatcacaaacaatgtccagtgccattagaaaatgctatattttttggtctttggtacatccatgcttcccactctctacaaaagtcttcccttccacaagtccttcttttcaactcacttaggctcagccaataacttctaccaatttggtacaattcagtgataatgatcctctaaccccaacactaaaatagcagctcacctgtatttgctctttccttacactggcagcagtattggtgcacctaagccaaccctcctgtcgtatctctgacccacccacatttgcttacccaaagtccccaatactgggattatcttttctcccttaaattatttcatcactaaattattcataataacatacagacttttttttattagtaatcatgtcttaggataaaccctgtcccttttcccccccatgatccatttctctcttcacataatcttaaaagaatttgtttatacttactgcatctatgttcttaccatttccccctttcatgtatctgtctgagtacccttatttttacacccattgattcactaaaatggtttttattaatattttttggtagattctattgtagcagtcaatttttggcactaatctattcagcctcttataggttaagaataagattgagtttctttttccttcttatttgtttttttctgtaattatgaaacaatgattattaatagataatgaaagtatattcacaattcactttaatggtatagttttccattttgaagtttcactaagctatctgaacaagacttattgaacatgtgtgttgtggaacaatcttattgaaaactgtgaagatgtgttgctttcattggtttaataaagagctaaatggtcaatagctaggcaggaggatgtataggcaggagagccagacagagaattctgggaagaagacgagctgagtcacctgccagatggagagggagcaagacatacaagaggacaggtaaataccacgaatcatgtagcaacatgtagattgataaaaatgggttagtttaagctgtaagagctggttagtaacaagtctaagctattgtctgagcattcataatcaataataagtctctgtgtggttactagggaattggctggcaggtcagaaaattcctcctacacatatgactgaggggttgattatgtctgattgggtagataaatgtttctttctttattgaagccttttctccctcacaccaccaagtttccctttgtattttctttaactatcttcccagacattggatatcctttttatacttctctagttcctactgtttactacttgatcttggaatgacctaatgttggggagtgtatgtctaattacatgggtatagattctgactctgtcatttcctagcaatatgaccttgggaatttaatactatttttgtttttgaaaaatgagggtctgaggggtgttgagggggctcagtaggtaaaagcacttgctgccaagcctgaatagcttgagtttgattccaggaacccacatggtagaaggagagaactgactctcataagttgtcctctgacctccataactatagacagacaaacagatacacacacagaaacacacagacacactcacacacaaacacagacacacacacacacacacacacacacacacacacttctgcttgtttctaactcatgcgatactaaatgtccacagacaaagtgacatgagaaaaatttgccttcctagcctgctggctacacgtgtcctcagaccattccatgcccctaaacatgaagaactgaaagacaaatgaggggggcaagagaggatagtagaagggtgaatatgatcaaggtacatggtgtgcatgtatgaaaatgtcataacaaaacccattattttgtataatatatggtaaatttaaaaaataaaattctaatgttaaaaacagggaaaggagagaaaaaatcttagtactagagatgtttcaaggattaaacaaattaatacggtcagagcatattgaatgactcttgttcataataaatctatattagtttatattaatgctagatatcataaatcatcactcttttcacttggtgctaaagtagaagaatacctgtcatatgggccaagggactagaaaatgattgtaggtggccatcatgtctgccacacagactatatgtacatgagataatgagggcagtatgtaaaaggagtcaagatagatttgaggggctgtggagatggctttgtggataaagcacttgccattcaagcatgaggactagagttggatacccggaacccacataaagctgggcaaactgactatctagactacctgaactggctatctagactacctaaactggctagctagactaactgaactggctgtctagactaactgaactggctatgtaaattaattgaactggttgtctagactaactgaagtggctagctggactacctgaattgtgagctgaagtttcagcaagagacctgccttaatatggaaattagtgagcattaaggaagatatctaacataaaacatggccttcataggcacatgcacacatgtacagatatgtacatatccacacatgtgaacacacatgcataaatgcacaccctcacacatttagataaaagaaggaattggcataacagtcaaaactttggtttggagcaacagaagccattcctgataattcagataaattaggtagagatggtttattggaagattttagaaagtcctggagttccagagctttgggaaagtggggttaattgtccattgtcattattagtgcaactgagaacaaagactaacttactgagaaaggattctagcaaactgtcattcttagtatgtattgctacttgataggacccaaatttcaaacttgaagctagaatctgagccactgttgccccagaaagggtcttcctctacactattcttgtcaatcagtctccaactgtagggccattcgctgctaactcatgctgattttcctgcctcagtcttgcttccttccttcattctttttttttttttagatttataaaatttttgtattttttattagaaagaaaattattttacatgtcaatcccaagtccctctcccttccctcctcccctgcccccccccaactaatgtcctacccatcccataccctttctgctccccagaaaggatgaggccttccatagggatcttcaaaatctgtcatattctttgggatagggcctaggtcaacccccttgtgtctaggctcagggattattcctccatgtgggatgggctcctaaagtccattcctatggtatcaataagtactgatccactacaagaggccccatagatttccaagttctcctcactgacacccacattcagggggtctggatcagtcccatgctggtttcccagctatcagtctggggaccaagagttttcccttgttcaggtcagctgtttctgtgggtttcaccagcctggtatggacccctctgctcatcagttctctttctctgcatctggattccagttcaaggtttagctgtggctgtctgcttctacttccaccagctgctggatgaagactatacaatgtcatatgaattaatcatcaatctcattatcataagagggcatttaaagtagcctctcctctgttgcttagattgttacttggtgtcatctttgcagctctccagacatttccctagtgcctgatttctctttaaacctataatgtctccctctactatattatctattatcttgctctcttctgttttcccccaactcaacctccctgtcccatcatgtcttccccacccctcctcttctccccttctcattctcctagttccctccctctccccccatgctcccaatttgctcaggagatcttgtccctttccccttctccaggggaccatgtatgtctctcttagggtcctccttgtttaccagcctctctggcagcctgggctgcaggctggtaatcctttactctatgtctaaaatccacatatgagtgagtacatacaatgactatctttttgtgactggattacctcgctcagaatggtttcttctagttccatccatttgcctgcgaatttcaagattccattgcttttttccactgagtagtgctctattgtgtaaatgtaccacattttctctacccattctttagttgaggggcatctaggttgtttccaggttctggctattacaaataatgctgctatgaacatagttgaacagatgtccttgttgaatgagtgtgtttcttttggatatatgcctaagagtggaatttctggatcttgtggcagactgattcccattttcttgaggaatcaccatagagatttccaaagtggctgtacgagttggcactcccaccagcagtggaggagtgttcccttttctccacaacctctccagcataaactttcattggtgtttttgattttagccattctaacaggagtaagatggtatttcagagttgttttgatttgcatttccctgatatctaaggatgttgagcactttcttatgtgtcttttagccatttagattcctctgttgagaattgtctatttagttctgtacaccactttttaattggattagttggtgttttggagactagcttcttgagttctttgtaaattttggagatcagccatctgtcgaattcttttctttaactatcatatcctcatcttatcagggccttcaaacagactatttcttgtccctagagagtcccttccaccctttgccattcttcctattatattccatcactgtatgcctcctagattctgccttaattttcatctttcatttagatgttacttcttgaatagcattgcaatgggagctccttgggactagggatttgtatgttttgttagctattgcttcctattacatagaggagtgactgccaaataaatgaatgggcaaggcagctctcagtattcgtgaggcctcctaaatttatctccagtatttagcattcacagtgtgtctggtactttagtttgcctggtattttgtttaaatctgtattcacaccaaaggccattatcaacagagtaaaaaaagcaactcatgaaatgaaaaaaaatgtttgcaaattgtgctcattacttttctcagtactgtgatacaatatttggcaaaaacaacttcaggaaggaacggtttagttggctcctagtttaagaagagacacagttcatcatggaggaggagttttggtggcgggagtgtgaggtggccggtcacatggcatctgcagtcaggaagtagagataagcttcatcactctctcctttttgttcagtccagggcccaagcctatgggaccctgctgttcatattcagaatgggtcttctgtctgtgacagtgtttactgacacttccttatggacacatggagaggctggttccttatgtgacttcaaagccaatcaagtcaacaatgaaaatgaaccatcacaccaaccatacatctgaaaacgggttaatcttcagacttgtaaaaaatttcctaaaactctacaataatgtaaaataaattttaatagggatgaggtcttgtgtaaacgtttctgcaaagaagatacacaaatgggcaataaacacatgaaatgatttgaaaggttagtcgccattcagggactgaacatcgaacccacaataagatcctgcttcctacttatttggaggctggctgttttcaaaagaagcaggcaaacaaacaagccagaaaataacacgtgttggtgaggatgcagagaaattacaaccttcatgctttgctgggaggaatacaagattgcacagcttgagaaaagcagtctgctgttccccccagattaaagatagatttggatccggaaattccacttttagctatttccaaaagaactgaaagcagaggctgaaacataatgtacacctacatccacggcagccacattcacaatagctaaagggtggggacataacccaggacccattaataggggaacagatacacaaaatatgctgtgtgtgtgggggtgtgcgcgcatgtgggtgtgctctcgaatgtaagaactattcagctttataaagttgtgaagttttgaaccttgaggctactacatggaccttgaggccacccagtatgctgagtgagacaattcaaatacaaataggcaaatattgtgcaattccatctccatgaggtacctagaattgtcaaattcataaataaagaaaaaaattgagcgtttttaggagctgagaagagatgagaagggaagtactctttaatgtaaactgcaaaacattagttttagaagacttaagaagttctgtggacggacagcccacaaatatgaatgcatgcattgctgctgaacggtgtgcctagagatgataaaaatggtaagctttctgttttgcgtagtattgccacaataaaaatgcaaattaaaaagaaaaaaaacctatattccctgtcccatttaagcttactgggggcaggaccttggctgtgttattccctgtatctaatgaaggatacagggagcagcagtaccatttgttggagctgagggaatgagcatagaaagagtgcctggactgagaggaaatgaagctatttgccgctaggtttccatcctgagaacattggccataacccattgtagggtctttttgtttatttgtttgatttttgtggcacaggttctgtctttgactcccacaatgctcctaaaccactcaacttctcagggtctagtctctgtatctttaaatttaaccagctgcctttggtgttctcaagagaattgatattcctatatgttacagtcctgggctctttcttaaggtggtgtctttgtgtgcgcgataagagtgacttaaactcacccactccccatccctcccttctgtggcaggtctcatctagtcagtctcagctgctgctattctttctcctaccctggaggtgcgtagctgccatgtactttcaatagatggaccatgaaggctttgctaagcggctcctatatcttttatgtctcttcatgtgtcagattgtaacccctagaggagcagagccaaattgttaatccacattcatggttctaaatttagtcaatgaacacattgggtttatcctcatgatgacgatgaagatgaacgccccctgttttggatggacctactgaatgttatatttttttcttggaatttttctggatggtttcttctttttcacttcagcaccttattcctccagagtgaaatgcatagacatagagaggtaaatggtctgaaaacgaatgcactgtaatacattcactctggctacaaaaataaaacaccccaaaccaagttttctttgcagtctttaaatccagatggcagtaaaatttgacatttcaattctgtttgtgagattcattttgtttttaaattgggaagaaccatggggctaaaaatgtctagagagctaggaaagcctagtgagacctctttagtgttgttattaataaggctgtggtatttaaaagggaatttttttacttttcctttttatcttttttttttaaaaaaaagcactcttatttacatatcagtcctcccattccctcgacctcccatcctcccaagctctccactgaccctccaacccaccccccacccactccccacgtacagcgaggccttccaccggggaccatcaaagtccatcacatcatttgggggagggcccaggccctccttcccgtatctgggctttaatagtatccctccatagggaatgggctcccaaagtccacttgttctctagggataaacactggctccactgttagaggtcccatagacttccctggcctcctagctggcaccctcattcagagggcttggttcggtccaaagctggtttcccagctttacgactagggtctccatactctcacgaggtcaggtcaactgtttctgtgggtttctccagcaagatcttggctcctttgctcatccctcctccctctcggcaactggattccaggagtatggctcagtgtttagctgtgggtggctgtttctgcttttgaaagggaattttgagacatagtagatagaggccgcacacatctctactggatatgaataagggccctggttcctcgaagtatagagctagctggttctcaccaattgtgaaagggacaatgcaaggaagaggataaggacaaaaataatagctgttttggtgaccaaattaaaccaatgtttaaaaataaaaactcactccctagtgagtctggaattttaaaatttgcagtaggattatgacacttgtagttgatacataaatattcacattagttgtactgtatagacagatgcatgtagttcccattacaaggctgggttattgttcaaaatagtcttcttgctccccaccttgaaacatggttcctctgtgtagctttggcttctctgggactctctatatatttcagggtggtcttaaactcatggagatgcgcccactctgcctcctgagtgctggtattaaagcaccaccacctcctggctgtcaacagtccttttgtactgaagtactgaaactaagaagaagtcttttcactaaaggtgtccttaagtggaaggcacaacttaattaaactcaagatttagtggttcagagctgctgaaactaggtgaatacttcccaacacttctttggtaggaattacttttggttagagtgtcccctttataccttcttaaagaaaatcatagaaaataattggcagttgtgtattgtaattagtgatatgattaaattccttttggttgaaagggaaaaagcttgccctatctgaattaataaaggactatttgcttctgcaattgacaactctaacagggaggctagactagctttgcaatacctctaggtttgtctcactccccacttctctcccttccacttagtggcctctttctccaacagggtctcttcatgggtacaggaagactgactttcaaggctccatgacccaagatggcaagtctgtggtagaagagagaacctccacatctcagaagatgaatgaatgtctcatgtctgttgatgatccagatcaggccatgtgtcaatccttaaatcaattactctagagcagtgtttcccaaccttcctaatgctgaggtcctttattacctgttctcatttcgtgtgatctgcaaccataacattatttctttgctacttcataactgtaattttgttactgttatgaatgataatgtaaatatctgatatgcaaccccaaaaggggtcctgacccacaggttgagaagtgctgctctaagtaaaaggacatgatatgctgattaatttagtcatggccacagtaaaattaagaagggaataggccatgcaaatcatgtggcctggcattgacgggaaattaggaagactcatgtaaatacagtgaccaaaatggcaaatatcaggtatattatagctaattaaaggactcatgacatagctaactaaaggacttatgaatgtcaataaacctttagcagagcatttattaaccatttattaacattggttattacacagtaggatgtgtgatgatggccaagaaaccttgtctccttccatatgactatggtataggacacctctaagttctcagagttaacataaaatgtatcctgattctcacacatttaccacaatcccctgactattgtggtatcttacagaaagatatattaataccctctgcctccagggcatgtatcactatgtagccatggctggcccagaactcactatatagaccagactggcctcaaactaacagagttccacctgcctctgtctcccaagtgctgagactaaagttgtgtacaaccacacctgaccctcatatctttctcatgagatgcacatattctatggagacaagagaacaatttttgcaaactttccattccttttgttaagcaaattttaggtgtagaccaaaaggagaaagagttgttttgggcactgggcacctctgtgtgaagatattacaccaatgtacaagaactgagttatctgtatggtaacagccatagctccctccactaagtccagtgcagggttttcctgtctatttccttacatgtctctgtttcctctataaatacacaacacaagcacatataaatgtatacagtgtatgtatatatggtagcctgtgtatacacaggtaatattaaaatatttaacaagtgatatagcatattcatccaccagagtgaacgttacccacaaaggagcaatacaactatactaggacacaggtactgactcgggccttgtatagtaggaacaaaacattgttccaagtgaatttccaaaggcttgtcactcccaactcccaatgtacaacaatcagatgaacggttcttgtcataaccgatgacaggggaaggcagtctctgcttcataggagactacacagcagtgcatgtcatatgacaagggcaaatcagtggacaaggaagaagaatgcagggtgaggaagcagcatgggggaggaagagagggtgaggaagctgcacagatggagttcctcagagttggagaatgagatcagagcatttagagatggagaaggaagggatagggtgagattttaacatgttactcaggaccaggtccttgtattctcttgaataggctttgagcagtgcaagaatattgaatgttgcacacttgaaagtgaattctctaaaaatgcatgacttaggtttccagattgagaaaggaaatttgctaacctgctcataatcatagctgaaggggacaaagtggccatgttttgtgctacaaaagtgacttctacttttgtcactgaactgaggaaaagttcctggatgtagggttgcctgaatgttggccagttactgcgatgtgatctgggatgtgatctgggaaaagcagaaaatctgcccaccagctttctcttctttggaacttgtgttaccaaagtcaacacattcacctgcctgaccagtgtcatgcacatttgaggaaagaagagcaagaaactgacaggaattgcaggttggggaataactctgaaaggactgaaacagactagtagaaagttaagaacacatagagagatatttcctaaggccgggtcaagaggggtttgaagagctgcaggaactgagttccaggcagagggcacagcaaggctaatgactcttaagtaggactgagcttgctggtgatgagagggtcaccctggagtagcattgtgaaggagaggcagcaagagccctgtgtcacacacagagaggttctctccacagaagtgtgggtttgcttcccaagtgcactaaaagccttgagaatctgaagtggacaatgacctgatgtgtgtgaacaggggcattccccgagagaacccagagagaacacctctgagggggagaaaataagggaagagttttctcagggagatgactcagggactcttgacttggagggattggagaacagaaaccaaggatgggaagacacatgattcatatgaagtagagataccctggtacagagggcaggatgagatagctaagacagcggggaacacagagggcactgggaatccaactgtctccatgttcggtggcttcccatctcccccgagtactccctgaacagtggatcctctgaggtcttcccttccttatggctccatttcttctttcattaaaccaccctctccttgaagagctaccttgagagactgttactagaaactaaacctagctaatgataatgagtgggacccagctgcatactgcatcatgtaacttgccttacttctcaactcaaaatgggtatctttcacagccatgttacggtgactacagcatcaccttggtgcagatagtgtctgtgttggacacttgtgctctctctcactgtatttttctctcagtccatttcattctggctgtcccatgggtggtacctcgttcaaagctgctgctatagcctcactgtgtatttctcagtttctgtcttgggcttctcacaccccatgtgggaaacccgtggggatccacttagcacttgagtatgtgcagacttggaagcgtgacagtgttaatccacactggaaaaaccttacccaatggaggatgggaggcaatgagtaaatgctccccagtactgtcttagaggctgacaatctgaagggattgtatccttttgtggttccatagaggctcctatctgaataatcaccagtttgcaatactttctggttttgtaatccatctttataaagagtttccttttctattctccatgtcacagtccttcatggctcctcctcgggtttacctcccaaagtaaactacatctgtgtgaaaactcagcctcagccttctggctgggactcaggccaacctgctgccctctgtatctccttacaatgcacatttaaatggagtcctttttcttttctttctttctttttgttacaccccaatgggaaatagatctttgcaatttctttagaaaaaaatctactacaaatgaaattactaaatttatgactgaataacatacacactttaaacctttttgtatgttctggagcaaacccacttacatttaacagtttcatatgtttgtggaaagaaattagccactacttcagggtcaatatatatatatatatataaattttcccttgtggggctggttgtatgctcagtctggctgccttccaggacttacactaacacttctggtgtgactctggacagattcactctactgcagtgaagtcaaacacagcactgtgtttgggaggtttgactttgcccatcacaatttgagtctttctaccattataaggtaagaagtagtgggggattaagatgtcaatggaattaaaagactggtgtgttttaggtttgaggcagtatttctactcaagaaagttttcaaaaactataaagaccttttgtctaagcactagtgcctcaaggccactggaaaggtattttttcttgacaggaaagaaggtggcaccagtagctatctctgtgacatgtcactgaaaaacaaagtggtaagtagtcctaggtctgttttaaagccactttaaaagtcagcccagattgattttcccaaactcttgtccttggcaagggttacttcaccattactgcagtcaaaatagagcggcagttagcaagcatgaaaggaaacaatgcttagatatggtatcacattgactggttctcctgattgtacctgctttacacatactttagaaagccctgccacatggcacacaggcaggcagctggccatatgtggcgactgaggtttccacacaggcttgctctgtaaacgcctggttagaactacggttgtgtctgcaaaagccaacatcctatttggaacattttgatttaatagcactttccgaattatcttgacctgtaataagaatgttgggccttggcttctgatcattgtttccatggaacaatgagagtctgtgtgtgttgtgttgatttaagatgacttttactggaacctaacctacttaaagggatgctttccccctgggttctctgggtgtaaacatgctgggtctgtagtcagaggtaatcataaggtttaaaattgcttctaggaagcattcctaatggttaagttcggactgcagaggcagagccacaagaggaaggtggggacaggccaatcagagagttttgggccggagtggaggggctgtgagaaagtacttgatgattccgagaatggaactgtccgggagaaactggaccatttgaaactgtgatcagactatcttgtaggttatgagttgaaagggagttcagtgcatgttagaaagctggtttaggcttgagatgatggccgaggcgaatgggatggcattagaagcaagcataaaaggggagaggatattggaggcatttgaaaatatgcaggatgtggaatagtagaagaactggggaagaatggtcaggaggacagcatttgtgtttgcaaaggtagtcggggactttgaaggcctgctttcttccctctccctgtccctccttccctcccttcctccttccttctcttttgttcttagacattgtgttgctgtgtagcctgtattaaccttgaactcaaagcaaccctcctgagtgttgcgattgcaaacatgcacctcagtgactggatttggggaccccacctttcccacccccatcttcaggtccaaagcatggcttgacccagaataaataataaatactcacgtatataagaacacttgtatctcccaaagtgactgtctattttttttttcccaagacagggtttctctgtggcttcggaggctgtcctggtagtagttcttgtagaccactttggtctcgaactcatagagatccacctgcatctgcctcccaagtgctggaattaaaggcatgcgtcaccactgcctggcaaggattctctgtggttctaagattgattctccactgtctgtttattcctacttgggatttaccagccatagctctgtccctcagcatggcttgcttggttctgtttatatcataaaaaggtaataaaatcacccttttattttcttccacaactaaatctcagcctctccaaagggtggggtttgtgtggctcttccttcgtctttgaaagcagaaagtgatttgtgggtagcctgactctccatttacttgccccatgaaaccactgagaacaaaatgctacatttgtatttacttcctttgtgtgctatgtggggactagaaggaaagggttgctttgcctggagaaagcagagacttgggtttataccaatgaaactcccccaggaaactagaagggcaatttagaaatccaaaacaaatgatgaaggctagaagaggataggaatgaaacaagtataatagaaaaatttaaaaccttatgggacattaagaaagtggcaacattattcagttgttaaaacaaacttggctcttattcttcaagagcctctgtcttagtttttgaggcaacatctctcactggcctgaagtaggccaggctgactagctagtgagcctagaggtccagtttgtaccaactactgggattactggtacaactactgggagtccatgtcatgcctggctctttaatctttatttatttatttgtaggctctaaggatcaaacttgggttcttgtgcttatatgctggtgtggcatggactttatcgactgagccaattctccagtcccagtgttatctatttactaccttttcactatggctccccctcagctcccgtcccacgcttcatattcacaagtcatggctgacacctcatttgttaagacttgataatgtagtctatgtaagtcatgagatacagctgctgtggttggaactgctagtttggtgaggctgtgaaaaggtatgtagaaatttattaggagctgcctgagacacaaatcagcccgtctatccttcactactgtttataacctacatatttacacccacatagtatttcccctgagtcacagcattccactcaggatctgatggcccttttaggtctagtccaccttggaactttcattctaaagacacactgacacacagtcctgtcacaggcattaagaacacctgagtgtctccctggtaacattgtaacattgtcctcttgctgttagggcctgaacttgtttgatttaacagatttatgactggaccattgcctatcctgacattcttttaatggttacatcgttctcatctttgagagaatgtcttggtaataggtgcaggattgttgaacttagattcaacaatctgtgtttattaaatttaaggagtgcatattcatgaggcagacatggtgttaagtcaacagaatagtattggctacaaattctgggtcaatattgaaccgatgcatggggctgcagtagaactttatcctttgagtcccataaaaaaaaaaaaagagcccggtcttatgagaatagcatacaagtgtttagatacatcaggtaaacaataggaggcattactagctttctgttgtggtttcaggtgcctggcttgctgtctggcattagtggctctcttgcctaggtatttaccaagctccagagggaactctgctgctaatggacccttcattcaaatcagagactcaccaagattttcaacctcagaacccccttaggggaactgttccacctgcaggtgtgcttcacataggaagattggagcagaaaatgttcatcttgacacacagcatccgattttagattacgaagacaaaataaatctccatattgttaatgtcttaaaggatgcccacttgtgtagcctggcagtgagacacccaggccaagtgccttcgactagaacacaatcaaacctgcttctgggggtgtttctttcatgagttctcttgggtgtcacagacacaggcctttctgggatgtcttcaagggtcagttgctataggattcagaaggctctggagaaggacagatgtctgtctgttagacacagcaaggtgatataagcctttgtcagtgatgggatcttgccctgcagttgctgtgtgcccgtggagctttctttagaatgacgctgggcagttagtgagcactggttcagctttcatgaggttgcatgggattagtgacttgtggtttctccagcccatctccattcatccacaaggccattgctatttctgtcaacccagaccaaatgatcctcagtgatcccaggaaacagagaggagggggtcatgcatctcttctctcttactctcagctctactgagaactttctattatactccagcttcacaccatgttatgactgtcctgatttcatatgaatacttagcctgtgttccatttcttcccagcatgtgcttgaagtctgtactgacaatctgtgatcatagctcgttaaaatgtgggtacctcagatggagtaggactgggtcatttcagggaagtgtgtgaataacaacatttcaaaccatcactttacatttcaacataatactcaaggcaggacacttaatttagacctcatgaagacgtcaaatgtaactgtcgaaacaactaactgaattgtcagaggacctccccatccaaccctctgtcatcccttgaatctggtaagaactcacaacttgtgttcaagaagagttgatgccagcagcacgtggcacagagaaccccttctggatacccagtctttccttaccgattcccatgctggcttgtgtgataattcagtctgttgtggaggaacaagccttgtgttgcctggtttctctgggatgcctgacctccagtgatgccctgccagatgtggtaatggatatttaatatatttttctctaaggatctaacattggtacctgtcttcctggctcagaaactcttgttacaccatcagaggaatttcagcacttcgttggagctcgtttctccacatatcctaagatatcctcaataacaacatcacacctctcctgggtatcactaggtatcattgacatctaccaaggcaggcaaacccagggaagagcttggcaacctgcgactttgcttggtttgggttatgtacacttccctttaataatgcgcctggcagcccagattctttagattcacataccatgttcacaaccttttctgaacaatacacccagcaaccctgggcccccagctttataggtttacatttacaatcccctctggacaatgggatatgtttttctttccttgatggctatcaaccttggacaatgtctattcaaatgtatccctagtatatcctggtcaaagagtaggatggttaatacactatgagctggttctgggtacacaggcagtgaggcaaaacagtgttctcaaatgaacttttagggagaatcccctatttatcatctaatatataatttgcaattgggtgttcatataattaaaattggatgcattatgggaagggacatgtgcaacagaaaaattattgtacgacttaacctatcaatcaaaacagagaactgccttcactatgtgtcttaaaaaccaaactcttccttttgaatcccataaaagaatgctctaaacaataatcagggcccccaagtactctcattcctgcagcctgttgtcaatcttgacagtgtatccctcaattatctatatcattgctttgctctgaataaagttaccttgctatctttgcccatatctgtgagtccttgtttcattttggaagaccagcttagacagcaacctccggaaatactatcacttcatccccactttccttctaagatattttctcagtggagcttagccgaggttaggagaaacagctagtcaccacagctccttcttgatgttttcataagagacattatttcctactaggaaacatgaagacttaactttcactattttcccctgcacctatcatgttggcatactttctactcctccatcctccaaatatggacatattggtatgtgagtggcatggtgattcagtgactgcatggttgtgattgtgcaaacacccttccaattatgagagccttgataacattttcttctctgcactgctctttgtcttcctttgaagtaataatgtgtaaacaagttccatgatcacgtatttgctgaattttctttgtgcttatgtctggagtaattgaaaactgcggcttgtggaccaaacatagccactacctgcttttgtaagcaaatctcactgaaatgcagcaaagttcatctgtttgcatacagtctacatgtgctttctctgtaagacaggttgtttgatgaagactgataaacctgaaatgtttattatttggccctttataggagaaatttgtcttttttcatcttatgtaattcaacctcacactcctcaaatgtttaggatcttctcatgaggccttcagaagcagccagcactctcttgacttcctgccttgaggcaatctcttttggaacaatctggcttggtttctgcccttttagtttgtacaggttgccccccttttacaattatttatttgctaattctctctctctctctctctctctctctctctctctctctctgtgtgtgtgtgtgtgtgtgtgtgtgtatgcactcatgccacagggaatgtgtggaagtcagaggacaacttgtaggagttggttctttccttccaccatgtggaccctgagttattgaactcaggctggtaggtttgacattaagcacctttacctgctgcaagccatcttcccaggcccacttttgccttcaacacagctctctgccgttgttaccctttatcattcatcttgggggctccctttgctctcttctataatggatcctttgccagatgtatctgatgtcttattttaccctgtgttattctttctttacatttttattctctccttctctctctctgtctctcctcatcatgtgtaagagtgtgtgtatatgtgcgtccatgcatgtgcacacatggttatgtgtgtgccacagcatacaagtggaagtcagaggacaactttctggagtcatttctttctttcaagtgtgtggattctgggcattgaatctgagtcatcaggcttaggggcaagtgccctttacatgtggggctctcttgccagccctggaatacaattttagtttcctgaagaaagactggtggaaagtcacatttttttctaatgttgcatattgaatatgtttattctaccttcaatcctgataaatagtttggctgggtataaaattctgggttggaaatcttttcttcttctctagaagtcattattcctttatcttcttgcttccagtgttattgaggggtctgaagctacccagattccacacttccttctatataactttgaaaataaatctcttcagagttcactggttcttttttcctttgttctcaggattgggccatttcatcatgctgtatcttgctgcgtatgtattttcatcatttaggtcaggcatttggcaaactcttttactctggcaatttatgtccttcagttctgggaaatggtctcgaattatgtaatcaatgttttcatactgtggcatgatttaatgcagagctgcttaaccaggggatgtataaaatgaactgggaaactttttaagatatgaactccccagcctggtctccagaatgagtgccaggataggttcaaaagctacacagagaaaccctggcttggaaacaaacaaacaaacaaaaaacaaaagaaagaaagaaagaaagaaagaaagaaagaaagaaagagatatgaactcacaggttccaatgctagaatttccaatttacatatcttgatattgtatgtatattttggtgatactcctgtaacaatcttgagaaacatgtctggatagatgtgactttgaagcaacagtcttagactatggtctactaagtgtgacatcattagagcaaaagtagctgaaaaagtacaatctttgccatcaagcctgagtccaaagattcctcaacaaccacttcaccacctcaacaaccagttgctgcgatgtaagtactctgattgtgagctgttaatattatacattggtttatgctatagcaattcacatgtggttagatgtatcattctacaattgctctcaaatacttctgatggtcgttttgtctacccagtcagacgataactttacagaagaagggcagtcattcatggactttgagtcattgctagtgtgttgtactgggttctgtggctcaaatatttgcattactaatgaggacagtctgataggaggaatttatgcattcttctcattaactgaggagacataaaatagagcttacctagtgattactaaatcaaatatccagaatgatacttcttagccattgttattttcagtcgattgggtgacatcatgatgatccttcttgattctttgctttacatatcacttgaggagatgaaaaagataagctatttatctttacttaccactgactgtggatgcccatttattcctctatcagtcttgggtgatgttatacataaaattgcaatgtataaaaacatttatgacttctatttgttcataagatcctccaggacagaagccttgttttgatcactttcatatttccaactcttgcatttgacattgtctgagcactcagcataaattttgttgaacgaatctttatgtttatgcataatgctgactaattcccaggccagcagttctttgggattctgaaacgttattgattttcaaaatagaacattaagttttccacacttctgagagctattagatgtttaaccatagatatttgtgatcatcttcaattatcaaggaaataaatggacttgggctttgtggtacttgacttaggggcattacttgttcccattcaataaaaaaggcattcactaaatagtctctatttttagctttctaaaaaattctagtatatagagcattagtttagaaatgaaacaagtctggcatagagaattcaaccgagctataaaggcatgcactgatgagcacatagaacatcatgtttcactgtatagtcaaagcaagcctggcacctgctacagaccaccaggctgtcctccactcacagagatccacctgcctctgctcccctagtgctaggattaaaggtgtgtgctatcatgcctggctcaaatcatttctgccggtggttaaaaatacactagaaaatccataacttaaaccacttaaaaacatacagtttggtggtattaagggtgttcttgatttgtgcatattatctatgatatctataatgccataatctagctcccaaaacatttctatcacctcagaagcaagcaggaaacatcaagcagtcacttcctgtctctaacctgctttcatttccatgggtttgctttttaaaaactttttattggttctttgtgtgtttcacatcatgtatcctgatcccactcatgtccttgtcccctcacttctaccctctgcccttgcaaccttccaccaaaacaaaatttaaatgtaaaaccaaaacaccagaatccaaaatgaaaaaaaaaagcaagcaagcaaacaagcaaaatcccaaataaaaacaaatttaaaaatatctcatagaggaagctgtagtgtggcccagtgagttacatagtataccctcagtccatacatctttacttgtaagtgttcattgcaatgagtcattggactggcttgtggcctctggtttctgctataccctcaataataggccctcactgggacacctcttggatatcatattgttgctttatatcatggagatcctgtaactttggatctgcaggtccagctccttcacatgctccaaaagttcatagatgaggggggtgttggtgtgggctacctcatagtcctggttctgggcctggatgatagctgggttgctcagcctgccagcttttcctcatcatcaccacaggtctgtctctccagcactgccctgactaggtcacccaatgcagcagacagcaaggaacagggccagttctcctgctcttgttccagttctcctcagttgtggaatattacttcaaccagtcaaagatgggctacatttgtttatgctgcagaatattactttgactatgtgaaggtgtgttacatttgtttttgctacatttgtttaactatgtagttacatttgtttaactatgaaaagatgtgttgctgtttcaccatgcctgcctaaggtatttgattggtctaataaagagctgaatggccaatacctagtcaggagaggattaggcagggctggcaggcagagagaataagtacaagaagaaatctaggcttgagagagaagaagagaacaagggagagagagggagatgtccagggccagccaggcagctgccagctagcagacacagagtaggacacacagaaagaaaggttaaaaagcccaaggcaccaccacaaccagattaataatattttttaattttgtattttatgtgtacagaaactggagttacaaacagttgtgagtcactgtgtgagtgctgggaatcacatgcctttaattccagcacttgggaggcagtggcaggaggatctctgtgagttcaaagccaggctggtctacagagtaagttctaggacagccagggctacacagagaaaccctgtctcaaaaaacaaaaaaccaaaatgaacaaagctccaaggcaaaatgtagatgaggagaaacaggttaatataagttagaggaaaaagaagctagacatgatcataagctaaggcctagctttcctaactaataataagtctctgttgtgatttgggagttgtttggtgtcctaaaagaaagcctgctacatccctcagatccaactcacccacactcactccttcaagaccagctctactgttttgcccaggtgaggtgcggggcccactctcccgattgctgcacttggtgaggggcagggccaactcttcaattctcatacccttaggtcagctttcctgcctgtcacaggtgggggtgaggggtggatatttcctttacccttgccaccccatgtcatatgtggggcaagggctactctcctgctctcatgcccacagacacagctcacctgtgcccccacaacagggtcagctctattgtgtggcccaggtgctggaggtagtgacaattctcccactctcatgacctcagggccagctctcccactcaagcatgttcagggttagcttgcctacacccctgctagcaggaacagctctactatgctacccaggggaggtgtgaggcctgctctctagagtgggagagttggtgaggggcaggaccagttctccctagtgctgcaggtcacttagactgacatggacctgtagtagaatattattttaaggtctgcaacttttctttatgctgcatttgtttaactctgtgaagctgtgctactctgcctgtctaaaatacctgatggtctaataaagaactaaatggtcaatagtgaggcagaagcaaggataggtggggctggcaagcagagagtataagtagaaggagaaataaggaagagaagaagataacaaggagatgaggctccagggccagctatccagctacacagcaatccatggagtaagagtaagatttacagaagtaagaaaacaggaaaagcccagaggcaaaagatagatgggataatgcaagttaaggaaagctggctagaaataagccaagccaggcattcataactaagaataagccttcctgtgtgatttatttgggagctgggtggtgggcccatcaaaaagccaaaagaacaaaagcatttcaaacaacatggacccaatggcagtgtggccctcaaacccccacatgcctcaggtgtagacccagatcccaggcatcagtatggccctttggtggcaacatgggccagcccagactcaggctgcagtaggaccatgagcccagacttggtccttggaaataccctgagccagatgtcatcgtggccttagttggtactgcagatttctcagattcatatggcccaagtgccagcatgggccccaaacaccaacattttcccaggtgacagttcagaccctggatatctactcatccttcaatggtgacaggagccatggacatcaacatagacattggctgtggtagggccatggacccagacatggcctacagctgcagttatggactagatgacaccatggcctcgatggcagcatgggccacccagacctggtggcagtttgaccctctaagaccaacatggcctcaggtgtcagcctggattgtgggcctctgtccagtgttcagacatggacatcaaactcagagcctatccacatcagggtcatggactcagacatgcctccctgaccctcctacagcagtctgggcctgacatcaccatggtcctgggtggcagtgcaggagatctggattgtcacggcccctgtgaggcacatcccatggatatcagcttggtcacaggtagtggcccagactctgggtgtccacagcatcctcggtggtaacaggagccacgaacatcaacacagatccccacagctgtaccaggaccatggaccaagtcatggaccttggaggcagccaaggcccaaggcccagacatcaccatggccctgggtggcaagcagagcatctccttaacctgtttctcaccacccttgcctctttagatctgtctctctccctagcacataaatcgttctacccttctctctcccatttcaccactctgtacttatttaccataatggtgcccaactgccagaggctggcaggctcatgagtgaaattcttctctccctaggtctagagacctggggtggagctgtgcttgtcctgcagggcctgccaggcctgagagtttgctttttttttttttagattttatttatttattatgtatacagttatctgcatgcatgcttgcacacgagaagagggcaccagatctcattacagatagttgtgagccactatgtggttgctggaaattgaactcaggacctctgaaagatcagtcagtgctcttaacctctgagccatctctccagcccgagaatttgctttttatccttagatttttcctataaatgggatggtggatacattatggatatttttgtggttgttattggcttctttcatttaacaaaatgtcttcaagcttcatcttttcagactttgtgattggctttagtctctgtaagcacccatgagtcctgtttagttgattctgtgggctgtgttctcctggtggtctcaacccctctgactcttataatttttcctctccttcttccactgggttccccaagctccaagggggagggagacccaatgaagacctccaatttgggctctctctctacctaatgtttggctgtgggtctctacatatgctcccaccagctgctggaggaagcttctctgatgtcaacctggctaggcatggacctatgagtacaggagaatatcattaagaatcatttcattgattttttttctatcctagatccccaagcatctatcctccaagtcctagtcatccaggcagtgtttggagtgggccttaaattagatcagtcattagtgggtcactcccacaagttccatgcctccattgccccagcacatcttgcaggcaggatagattgtaggttgaaggttttatggctggctgggttgatgtcccagtcctaccactgggaatcttgcctggttatagacgatgaccatttcaggctctgaatcctccattacaaagagtcctcattagggtcacccttgtaaaatcctggaagtttctactgtactaggttttctattaggttgcctcaaccagtcttgatatgagggtttcaattcattttgtttttaaaaattaatttatttgtatgtgtgtttgcttgcctgagctcatgtgtgccacacatgtacagaggccagaagagggtgttgaatccctggaattgaaattaagaggggtttatgagccttcatgtgagttctgggaactgatcccaggtcctctgcaagagccaagtactcttaaccactgagccatctccctaggtcccgagttttcagttctttgggggcatatacctaggtgtaaatttctggattctaaggtcattttctgtttggcttgctgaataactgaccaacgaagttattcactagttcacattcccaccagcaatgtaaggcatttctaattcctctgtatctcagccagcacttatttttctcttgagaatattttctaacctgtctccttctttgtcttttccctttctcttcacagattcatttatttttatttatgtgcatgtgtgtacctcaatgtctgtgtgtaccatgtgtctcagaggccagaagagggtgtcagagccaccagaactagagtttcaggaggttgtgagccacctgatatgggtgctaagaactgaacccacatcctctaaagggcaaaatgcactcttaactgttgagtagtccccccagtccctgctctttcttttaactggcatttactagtggtgtgaagtaatggttttcactgtgaggttttcatccacacaaatgactattcgttgctcctgtactctttcttgttcttctcttccccagtcctctttcacttcacaaataatctcttttctattttacatctttttattttaattgcttatttaagattttcttttattattataattgtgtgcgtgtgtgtgtgtgtgtgtgtgtgtgtgtgtgtgtgtgtgtgtgtgtgtatgtgtgtgtgaatgtgggggcatctgtgctaaggtgtgtatgtggaggtgacatgacagctatgtagagttagttttctccttccaccctgtggcttgaatgagaatggccccataggctcatagatttgaatacttcttagccggggagtggcactatttgaaaggtttagcagctatgaccttgttggaggaagtatttgaagtttcaaaagcctattccaagcctagtctctcttttcttgccacctgtggatctggatgtacaactctgagctcctagcactatgtctgcctgcatgtcaccacactccctgctgtgatgataatggactaaacctctgaaactgtaagcaagccccaaataaatgctttcctttatttgtttgtttaagtttttgttttttgagacagggtttctctgtgtaaccttggaacttgcttcgtagaccaggctggccttgaactcacagagctgggattaaagcatgtgccaccaccacctggcaagtgctttcttttataagagttgacattgtcatggtgtttctttatgcaatagaagagtgacctagacacctttatgtggattccaggggatcaaacccaggtttgtcaggtgtgtgtgccaagcacttttacccacctcgacatcgctccagcccccttcatttattaatctagattattaagattgatattttaccaaggattttagtctttggtgtaaattcttatctctctgttgggcatatttataacaccatattgttatttttataccatttattttatgattacatattttgtgggacagttctgacttttgacccacttaccattttggtgctgtgtgtgatttctggctgagttaaatggttgtctatcatggagccatggtgtctgtaggacagccaacttgctgctgttgatcactatcgacaattttcatcttcttggggggtatttccaggattatagcttcagtggagactgctcatctttctctttctatcttttatttttgaacatctaataacttcatgccaacaaacataaggtgatggagcattctttctgctatgatgtcagaaagaatatgtttgtaggaaagactctgttgttcaaaggaagcagtgacttcctctgttggaaaggacttcaggccacagtgtgtggcaggcctaagactttcactgtctgtttcatggtgacagaagtttgcagactaagacataggaggaatggcccaaggcagcaatgttcatgaccattgttttgctcaagctgaaggcacagacttatcagaaatatcagaatacacatttaaaacagttattctttcctttttaaagcaaatttgctctggggtgataaaggctgtccacgtcttcaattgtcagagtctgcttttagaattcacaggaggccttgagttaattacaacaatccagtgataaataaagataacaaagagcaatacaagtaatctcagcattccaaaggcagaggtactctgtgagtttgaggccagccaccatagtctacaaggagagttcccagccagccagggctacacagagagagaccttgtctcaataagagagaaaacaattggtccattagtgttaaaggttgtccctgcctttctcatttggttccccaaagaaacatccaaatagaagccaatgtatagaaactgtgacaatattcatggatgctgtatcatttggaaatggatatctttgttccaaaagaaataatcaatactatgagctgtctctaaggttgatggacagtcttcaaaggggaaaaattcatccaaccgggtcagaaaccattagatgtgtaaggacattgaagagtgccatggatatagctcaattgttaccaagcattgtttagtttgcctgaaggcctgggtttgatccccagagccacataaagctggacacggtgacatgtaacccaggcacttgggggtaaaggcaagagaatcagaagttcaagatccttggctatgtggcaaagtttgaagccagcctgggctgcatgagactctgtctcaaattaaaaataaataaataaaaagaaagaaaattagtaagagactcatagggaataaaagacaaagaaaacatatagtgtttttttaacataagcttttaaaaagcagcattgtgccatcacagacacataggctttcagagagtgggcaatattaacttgaacaatgcagaagagaaaaaaaaggttatacattgaagtaaactaaaatatttcaaaagaccagataatctgggggaaactttaatggttatcgttaaaggaattggaattctgtgtggacctgaggctcaacagtaactgtgcagtgccttcgttccaggtgctgagatgaggcaaggaggtgggtgacgaagaggcaaggaacgagaggaatgtaagcaaagatgtgcagtacaaagtgtgtacgaaggtcacaagagaacaggaggaacaagaggaggaagccatctactctcagtgatggtgcaacagaggaactcaacagagcaaatgctacaagcccagatttgaagtaaatctgcacaaggagccagtggacaaggactctggacagctacggtgtcattggccaagaagtaaaggcatgacagagaaacttatgctgtccagtgggcagtggctaatatagagactcacaactggccaaagtgaccgagagtgctcagctctagacaggacgaagatttcaaccccctcctgaggctcagggaccatcatggatgagggggcagagagaacatcagagttgaaggatgatggggagcgctatgaaatgctgtcctctgtacacgacaggaccatgcactcatgaactcaccgcagctgtgatgacctgtacaagacctgcacaggatcaagcctgtcaacataacagcccccactcccactgaggagctagttacagttgatggctgctagtctgagtcatgtgtataccagtaatactggttgaactcagtcgattagtttaaaaataagaaaggacatgccaggtacatttacatgcttttaatcccagaatttaggaggtaggaggatctctttgagattaggccagcctggtctacagaatgagtttcttggtctctctctctgtctctttgtctctctctgtctctgtctctgtctctgtctctctctctcacacacacacacacaaatccaaatgcaaccccccaaatataaaaaaaacaaaaccaaaccaaaaatcccaaaaccctcaaaaccaaccaaatttaaaaaaaattgagcatgaagctgagaggggagttgttgagagggaggcctgggtgcgggattggagcacgagggttcttagttacctcaaagggctcccagcacagaacctgtcatccatagttgactttgtgcgagcaagagatttctattatattgggtgactgagatcccaggctattctggggtatagcattgtctactctggccaacacacaggggtgatttcagtcttacaagtctctcctagggcatttgtcccaaaaattaaagacactgaaggaatggcagagacagcagtagtggctctttgggactaatgaggaactctggggtaaataatgaaatgtcttgagctctcagatattgttttagtatcagannnnnnnnnnnnnnnnnnnnnnnnnncatgtttgcagtttctttaaatttgcaaaatggggtacttattactctcgtaatataatattgtgaaaattaagagatgccatatgtaaaatgtctagaccatcgcctagcacatagcagcgccagaaccatcctgggagagtatcagaaattctatcccttaattaacttcgtaaatttctgatgtgattcacagatgggtgttgtttactttggtgacatctcataattttaaaattcctagttaagatctttgatttcactgccacagtctctgactatgcccaggttgatgcatgggtaagtacacaggaaataatagctattgttattctactgctgtcctttaaaaggacagaattaccactgtggacactgattagtttccaggttaggccagggcgcctggttctacatggccaaggctgttagctgggtgatggtgtgcaatcgattggatctatgccagcctaatttgttccaaagaccagaagggctggatggaactccgggcataagtgtgttctaatcacacttgctctctaattccttttctctataaacaatcataggaagtgttgggtgtgggtgcagtggtggatttccaagatcatgctgccacagttctcagcttccctgcttggtaacaatgggtgctccgaagaaagttccatttccctagttttgaatgcagtactttggactagtgggtacttttcctggcctattatacacacacacacacacacacacacacacacacacacacacacacacacacacacacttttaagagtcattttcctaactttttgttacggaaatataatggaaggccacacggctcaatctttgtgcaagaatgaattcaaaagcatgatctgatgcctaaaaagcagttagggtttgtgagctacttttgtactctcaacaaattgctaagggaggcacatatgtatattttctttggggggcactctttaaaaaccagctttttggcatataattcacatactgtacaagttacctatttgtttaattcagttgctgttaggacgggctacgtgattttcatgtagaaaaaagcatcttaggttcttccccctttattgcattgtgtcctttatcttcttccatacagatatcaggaggtgtatagacctcacagtctccagaatgccacttccctgtgctatacatacagatgctcgtatacatttgtacactcacatggttttctggtcttgtgtcttccttcctcctctgacaatctttctcagatctttaatatatgaatcaattaggacttgtccacttctttgttttctctttatttgccaatgatttggattctgaacatcaaaggaaaattcttgcataacccaaacaggaaggaaatttttcctattgtcctaagtggggatgtagtggtgggtagagggagaagcccgtgggtctgtagacaccactcttcccttcctagcccaggattcactctcttcttgccttattctctacagcttagctctagaaatgcatgttgcttccaagtaaggcccactgtcccaggggacaaactggaattaatttgagcagattgacacagattctgcacagctcatttatgctgtgaaacagttatcacttgccttctttttcagtcctatttaaggcaagtgcaactcttgatggcatctctggggtggtgtgggtgtgtctctgcattggcaggcctgtccctgcctgtagtggcaggcctttgactgataaggtcacacaaggcctcaaggctcctgggaagccactgacacatggtatagaaagctctttctgacccagttattcagtgtgttctgttgttttacgaaatcttactctgattaaaatcaattaaggaacatatatttattaaacacctgctgtgttcaaaatatgccttaaatattttatgtaatggttgatccttagccccatacagtttaaattgaaagcatggatatgtgagcaaattgacattaccatattagaactatactgaaatgtaagttctgggacaaatgaaaatttcaaactaaaaagtatatttgcaatagattgattagtaaataatatgttgcacattatagttttgtaatacagagacaaaaagaagatggtttaaagggaaataggttctgcttagaaatgactgttgttagcattttaaccaatattctttgagacacgttgctatgtatacacaggctttacataacaggataatatacttactatttgtaacctgcctcccaccctgaactcagccttatgtcaggaactggtttcctcatcagtagatatagactgatgcaattgtatttaatcataatagaatatttcattttatcgccatcatgtatttagctagtcccctattggtagacacttaaattatttcattacttattccaacggcttattctgtacagccattgattatgtgtacatggtgccattggtcttcacttgatcaaagaaaaggggaatgtgcactgtcatgcatatctcagaatccagttaccttggatcagaccctgctgctgatctgccctggtctcctaggtctgccccaaagcacttgggatggaaccagtctatggcctctgtgcatctctactaaggatactctataggtatggagcctaggtgcctactataggcagtgggacaggagttgggtcacccttattaataggtgacagggattgttaggcaattgtctcagttccttggcctgccgtggcatggttgtaagcaatgttttccattcagtctggaaaattcaactcagctgtggacagtgggctcccatctgtagactccttccccacccactactcttttgttgttgttgttgttttgagacaggatttctatgtgtaacagtcctggctgttctggaactcactccgtagattaggctcaaactcacagagatctgcctcccgagtgctgggattgaaggtgtgcgctactaccccccagctcctgcttcttattaaccaactttgcccctcccttgctgggatctctgggacatttcctcaaatctcaggctcagaatctgcttttggtgaaattcagtgaaaggtaacctttatgttactgatgcaaagtgcagtaggcaaagcagcgcacccccgacccagggtacccacatcttcatccccggaacgtatgaaaatgttgtgttacatggcaaaaggactgtggatgttgttaaatatgtaatcatggataagaatcttgaactgaagagctcgtgagacggcttagaaggtaaaggtgcttgtcatcaaacttgtcaacctgatctggattcctaggacccacatgacagaaagagagaactgactctcctgcaagttgtcctctgatctgcacgaatacattgtaatatgtacatgtgtttgtttctgtacacacacacacacacacacacacacacacacacacacgcatgcactaaataaatagatgtattattctactagaagtccaaaaataaccacaaaggtccttgacaattaaagagagaggcaggagagagccagagagaaaggttaacagtcacagagaaacagtgtggtgttttaagatgggagggtgccatgagccaaagagagtgggtggttactggaatcggaaagagacaagaaactagtcctctcctacacacagcctctgtagggaccaagggtgttgattttaattctttgccatttggactgggcttctaacctatgtaattgcactaacactgtggtaacatattacagcagcaataaaatctaatacagaatgctaaagaatgcaaggtggctgatgctagagcattgcatggctgtgtgatttattccaaggctgggcttgagcaaggaaggccaaaaggagcaaataagagagaggccagtcaggaagtgcattccttcctcctgagcataagccactttgctagggttaagtttagagtggctgactcactatctcctaacagaggctcctggccagagagcctcccgacaggctgggagtttgtatattttaatttacgtgaggatctgttaaatttcttaaaaccttaacacatataaaatgtatctgagagaatgaaaagttaaaaaaatctgctgggggaattcttggattccacttgcttgtggacctaatgcaaaagtctagaaataggatctggaatccacatctacaatcaggttataggctgggagtgtggtagaaggcttgcttgcctaaaaagtatgaagtactgggtttggttccaggcactgcataaaccaacatagtcacaaatgcttacagttcccagaatactgaggttgaaacagaaagatccagaattcaagatcattgttgtctacaaagtgagtccaagatcagcttgggctgtatgagactctactcgtataaacagataaataagaaagttattctggcatgtaaagttcaagaggactctctaagcacctgcccttggtgactggctgttcatacctcgccttgttaggtgacacaggcaaggtcagaagggaagggagtcacttgaagttttctactattgtttcttgattccaaatcatagttttgcttttactggggacagggagtcccagctgtcaatagcatcagccagtagctcttcacttgtcataaggaaggttacctgtgtctctggggacagagcatcaggcccctgagcccctggaggtattggatctagtagctgggctgcctaaagtagcatttcctcatttgactgctgtgcatgttcttgctgggtgaccttggagaagggggacagtatcgatgctaccaactaaaagctgcaaactataacatttggaatatctcagggattacagatgtgcccagggtgttcttccccagtgaaggccaaagaggtcaccttcaaagaatgctagcctttgtctgctgtctttttgaaggggcctctgcttgtctagctctgtgcagctccaaaatgtcaggagataagaaatgcctctcagcatggaggcttccagacacatatgtgacaagaaatttggcacgagcgttacaagtgtcagatgtctaggagaaagcaatatgggtatagtatttctggtgctattttggtacctcgtacatgagcttgcagcattagaaaaactacttctcagctttgggtgatagccttgctggcgctcagtgtgcatgtctgaaagtacagttgggtgacatactagttacgggccacagcaagttgcctacaatcaggggactgggtttcgagggggtgcctgtgagggggtccagacatcacacatcttgtggtgactcgggtggcatggctgcagagcctttcattagctcttgctatgtcttgcaaagttggtaaacataataccctcacctttcaggagtagtgagaggtccaacagaaagggccgtgcatacagtcagctgacttattgttgaatgtatcagaccagtgacaccagagccatatttctctctgtgtagctcaagaaatctgtcttctagcaggagagcatttttagatatccagcaaactgctgaaaaggcttgacattctctatctagctatcccctggttaagagtaaaggctcagggcacatggcttaatggttgtcatgacagtgaagaaaagatgcataaggaaggaagatgaaatgtggtgatgtagattgttatgacactaatgtccaatgaagtgtttacatccagtctgagtggtaatgcactctgcccaccctgtcttggtctcctagctggcacccacattcagagggcttggtttggtccagtgctgtttcccctaataggagaaaatatcacacatttggatatgtttaacaagaattatttacttcataattcaatatatatatctatatatgtctatatatattattcacaaaaggtttccaacacacatccatatcatcagcaaaaatatttaatatcattgtatgaaaacaaactttattgatatatatttgaataattagtaatagcaacggcaaatagagagtgttttcttcatggcagctttttttctttgtttgaaagcagaaaaggtgctttattcaatatagacagggtctccctatgtagcccttgctgacctggaactctctgtgaagaccagactgtttttgaattcacagagacctgcctgcttctggtgtccaaatgatgggatattaaggcatgtatacctatgcccagctttaaatttcatttctacttattcacttatttaaaatccagtactgagttgtgcgcatcacagtttattaaggtcaaaaagagcagaagggagagtcttttgaatgagcaaatgtgctgtcttgggtttctattgctgtgaagaaacaccatgaccatggcaactctttttttttttcagatttttttatttgaattagaaacaagattgttttacatgacaatcccagttccctctccctctcctcctcccctcccacccttctcccaactaaaaccctacctatcacatgtcctttctgcttcccagggagggtgaggccttccatagggggtcataagagtttatcatgtcctttgggatagggcctaggcccacccccgtgtgtcttggctcagggagtattcctctatgtgggaggggctcccaaagtccacacctatgctagggataagtactgaacttctacaggaggtcctgtagatttccgaggtctcctcactgaagcccatgttcctggggtctggatcagttccatgctggtatcccagctatcagtctggggaccaagagctctctgttgttcaggtcagttgtttctgtgggtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtatatctggggatttctgcctctgcttccatcagccactggatgagggctctaggatggcataaacattagtcatcaatctcattttaggggaagggcacttagggcctgatttctctgtaaacctaaaatgtctccctctattatggtatctcctttcttgttttcttctattcttccccctactcaacatttttgctccctcatgtcctcttcacccctcctcttctccccttctcattctcctagttccccccccacctcccatgctcccaatttgcttaggagatcttgtccctttccccttctccaggggaccatgtatgtctctcttagggtcccccttgtttcctagcttctctggcagtgtggattataggttggtaatcctttactctatgtctaaaacacacatatgagtgagtacataccacgtttgtctttttgttttgggttacctcgctcagaatggtttcttctagttccatccattttcctgcagatttaaagattccatttttttttctgctgtgtaaatggaccacattttttctatccattctttggttgagggacatgtaggttgcttccagtttctggctattacaaatagtgctgctatgaacatcgttgaacagatgtccttatggtaagaatgtgcatcctttgaatatatgtttaagagtggaattgctggatcttgcagtagactgattcccattttcctcaggaatcaccatactgatttccaaagtggctgtacaagttggcactcccaccagcaatggaggagtgttcccccttttccacatcctctccaggataaactgtcattgatgtttttgattttagccattctgacaggagtaagatggtatctcagagttgttttgatttgcatttccctgatggctaaggatgttgaacactttcttaagtgtctttcatccattttagattcctctattgagaattgtctatttagttctgtaccccactttttaattggattgtctggtgttttatagactagcttcttgagttctttgtatattttggagttcagtcctctgtcagatgtggggttgttgaatatcttttcccagtctgtgggctgccgttttgtcttaatgactgtgtccttagccttacagaagcttctcagtttcaggaggtcccttttaccaattgttgatctcagtgtctgtgctactggtgtaatgttcagcaagtggtctcctgtaccaattaattcaagggtatttccactttctcttctaatatgttcagtgtcgctggatttatgttgaggtctttgatctatttggacttaagttttgtgcatggtgatagacatggatctatctgcagtcttctatattccagcatacagttatgccagcaccatttgtagaagatgctttctttattccatcatatagatttagcttctttgtcaaaaatcaggtgttcgtaggtgtgtgggttaatgaccataacaactcttacaaaggaaagcatttaattggggtagcttatagtttcagaggtttagttcattatcattgtggtgggaagcaaggcagcatgaaggcagacaaggtgctggagatggagctgagaattcttactgaggtaccgggcatggcttgagcatatatgagacctcaaaacccgcctccacagtgacacatttcctctaacaaagtcacacctactccaacaaagccacacctcctaatagtgctacttcctatgaacttatgggggccaattacattcagactaccacatgttcgtaggaaaaggcttccagaaaagacaggcctgactatgaacctgtaggaagaatgaaatctgtgtgttctgtaaacacatgacagtcttttttttatagcagacacttttctctagatgaaagtggttttattttatctcagagcatgacgagtttaaagagtcgcagaaaagggttttctggtatggtggatggttacccaacagaattagggcccccagaaaggattcccacttctgaaggtcacttttgattatactaagtcaatcaaggcctgacggggttaatggattctgatggtttcccagaaccctgagatagggtgcttgttagtgatggtggtagctagtgaaacatttagacacacagaagagttgtaagtctagtgaatagagttcctgttgactttgcaattgcctcacctcaagcaggaccttgatacttattctccaagcactaacaatgaccctatgagtctattcttgatatttgttcaatacagttaaattggatttttttcttctcgttttgtctccaggtttttaaaaacagcaacattgttttaaattacatatgcatgtgcacaaatgagtgcaatgcctgtagaggctggaagagggcatcagatcccctgcagctgcagtcagaggctgttgtgggccacttggcatggtgcagggaactgaacttgggttctctgaagaagcagtctatactcttaaccactgaaccatctctccagccccacatgtcttacttcttcaaaatgtcttacttcttattcaaatacctgctcagatttccctgtctattccaactaaaataagattcttgcccctcttttcatctcctccacccctcttactcacaatttatatgtatggaaacaaaccatgattcctttttagtcaaatagctgtattttgaaatttctttgaatgatattagaaactcatttctcattttaatgtcatcataacattgtagttgctaatccataggattatttttgaaacaaaatgataaagcattttattgaaacatggtctcaattagctggaacctgaccttaaacttctgatcctcctgcctctacctcctaagtgtgggaataacagacatatgacaccatgcctggcttgaaaagaacaatttctgtgaagcaatttgagctagcagaaaggtgacaacacattcatgagagttatattgccattattaactagtgttgtgaaaaagtgatagagtcacacagtcctgtcagtgtcatgggaatcccaagacccaccaggtaattaggaacccagagcctagtgagtggattaagatcctgcaaaacactatatgcattggcactctaccgtatgacaactggtctgatcctaaaatctcgtttcttcatagaagattcagggataggtgtgagaccagcatacatctgttattaaaattattcatgtacctacacacagcagaaaagtactgggtacacaaaataattctttgtgcgtaaaggcaaaaaaaaattctttttttgtggataaattgtaccaaatcttatgaaagtgtttttgggtagctttgtgtggtagtgtcaggggctctgggctctcattccagtatggagggtctctgcagacaacaggactgacagaaaaatgatcctagtgaggcaggaagaaaacccagttcaacatgactcagcagccactgttggctcaaacttttagagtctctgtggtggttggattggaaatggcctcataggctcatagggagtgggcactattaggaggtgtggccttgttggaggaagtgagtcactgggggtgggctttgggttttagaagccaagtctagtccagtgtcagtctctctctctcttcctgctgcctgctgatccagttgtagaactcccagctactgttccagcaccttgtctgcctgtgtgccaccatgcttctcaccatgatgataacagactaaacctctgaagtgtaagccagctccagttaaaagttttccttttatggcagactctgaagatcccctatggaaggtctcaccctccctggggagaagaaaggggtatgtgataggtagtgttttagttggggggagggtggcaggggagtaggagagggagagggaactgggattgacatgtaaaccaatcttatttccaattcaataaaaaatttcctttataagagttgctgtggtcatggtgtttcttcacagcagtaaactttaaactaagacagtctgacacaaggcagtttattttagacgtatttttgtttctttgttttcaagagaggatctcattatgttgctctggttgtcctgaaactctctatgtagatcagtatggacttggacttagagatctgcctgcctctgcctcccaagtgctgaaattaaaggtgtgtgccattacaccctgcattgggcatatttaagtgcagtacaattttggaaaaatgtttcctcttaacagcaaactcaattcagtgtgcataataaagctaaaagcatgaatacatcaaaactcttttgtaaaatacaagtgacatcttccataaagatgggttttacaccttaagaacccaagggaggatctggtgtggtatccatcatagagatagcacaagggtcacctggctataagtacatgtggcatctaaggtcgccaggctataagtacatgtgacatctcccataagaatcagttctattgagtgagaaacgatgctcaagataaaggtctagggaggtggagtctggagtaaactactgacaacacaggtcacctgctatcaactgcattcaatccagccttctgaggagaaaacaggttatacatttcttctgttgaagagccaaccttcatgttcaatatgcctggtttccctagtgcttatctgtgagcacaaggatgttggtgttcccaacatccaggcagtcagggccctgtgccctcatctaggcagtcagggctggagagctggacagaggactctcattagctggtgagtgtggtgggcagaggatgagtccccaaagatgccacacactgattttcagagcctgtgaaagcattaggttgcatgacaaagaagaactatgattgatgtgaatctgtgttgtgccagttgactttgaggtgggtagatggtccaggattatctggatagacccaatataaacatgaggtccttaaaggggatgggtagaagaaagcatcattgtacagtgacttggaaaagacttggcttgccattgttgggtttgaagaggggtatgagtcagagaacagtcccaagaagctgaagaagactagatcttaaattctcctgagccttctgggagaggaagatagctttgtcatagcccatgtggcatactatctgagttttggcttccattattgaaaacaatagatgtggatttcaggcatgaaatacatttttatttactgtttctttttttttttcaagacaggttttttctgtgtagctttagagcctaaaatttaggaactttaaaaaaatatttaatgtattttatgtgcattggtgttttgccatgtgtgtcagatccccaggaactggagttacagatgattgtgagctgccatgtgggtgctgggtaatgaacctgggtcttctgggtgagcactcagtgctcttaatgtctgagttattttttaatttttttattgttccatatcttatttcttttattagttcaaatcaggaacaagcttgtttcacatgtcaatcccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttcacgtgggatgggctctcaaaagccccacctacaacagggaaaaacactaatccactaccaggggccccctggagtgcagaggcctccttattgacatccatgttcaggggtctggatcagttctgtactggccttccagacagcatctggggtcgatgtgctcccccttgttcaggccagctgtttcagtgggtttctccaacctggtccctctctgcaactaagttgcagagttcagttcagtgtatatctgtggatgtctacctcttccatcagccactagatgagggctctaggatggcataaacattagtcatcaatctcattttaggggaagggcacttaggttatcctgtccaccattgcctggattgtcagttcgtgtcatccttgtaggtctctggaaatctccctagtgccagatctctcctcggacctatgatggctccctctaatatggtatctctcattctgctctctctcctctattcttcccccaactcaatatttctgctcctccatttcctcctctcctttgctcttctcctgctctcattctggaagctccctcttccctaccttcatgctcccaatcagcccaggatttcctgccccctcccattcctggggtccaagcgtttatcccctagagtccttcatgtttccgaatttctttggtgaagaggatcactgagttatttttatttgttataccagctgtagggaacagttcacacagtcttccttccttccttccttccttccttccttccttccttccttccttcctttctttctttctttctttgcctctttgttttgttttgttttttgagatagggtttctctgtgtagctttggagcctgttctggaacttgctctgtagatcaggctgacttcaaactcacagagacccacctgcccctgcctccgagtgctgggatcaagggtgtggaccaccacccagctcacacagtcttcttcatatccctgtataacctgcactcaaagcccttctgagctacctgcctttatccccttgtcttctgctcttgctagatcagttttctctctgtgtccaaggattcacacattccaccccctacctccaatgcacacacactcactagttattgtcccatctgtgggattctctgattggtaaagaatttgtccctcttggtgtaatgaatatggatggacaatatcccttttccccaggaactgttagtcaagctgtacctggtccttcaggtaatcagctgttcagaaatttctgtcaaaatggtttatatttctgcagtaccagcattgaccctgaagtcccaaagataaacaaaggacttactttctgggcatgaagattggcaagtctgaggacatgaagtgcagtagcagttacaaagaggtaggcaatgaagagaaagaaggcctgaatgtctagtagaggtaggtgtgaggtccaacactggaatggggtgaaacttctcaggtaaagggatgaagtgacttgttaaggatgagtcgacagagctcttttgggcagaatatagttagctcaatcataatgtcatcactagagtggtcagaggggaaataagatgcatttcatgcagggatgcaagctggtttgcagagtcatagaggcatcagctatcataggccaaccagggtggaacaattagcagaagtcagctatcaaatggctttgcaggtcataccgagtaattagttcatagggagccactcccccctttaagtgtttattttaggaatattccactgcttgttacaggtcagttagatatggaaggactgaagtcaaaggcagaaagagaacatgtaaggctgtgatctaggggaagccattgaagtctgaactaaggcacccattactaatttggagggagagcaattggtatgagaagtgtttaggaagaaacagaaaggaggacaaagtggatggatgggtaatcagaacactgctctcttagatgagaacattgaatgtatgagaaaatgggaagttcagtttagtgttgcctctgaagtgctcatagactatgatgatgggcatactgagcaggcagttgattttaactccaggcagagaatttaggccaggaacaattttggaacagttcttactggtgacagtggaggatgagaactgtaagtacataggatggaaagatatgatacagggggttttaggagatgcacatgaccaaagtgtccccatgtcttagcttgggcttctataataaaacatctgactcatagcgaagagtttctctcatttctggaagttgagtggtccaggaccaagccattaggtgaaaattctctcctcatcctcttgagatggcagctgtgacctgttgtgtcagcacctggtcagcacctggtagggaatagggcacaaggagagtactgtccgtttcttcttttccattaacagctgcaccctcatgatataatcaccttgaaatgtccccctcctaataccatcatgttggggatcaagagttcaacatgtgtgttttgagaggcgcattcggtccacagtaccagggaagaaagggaaagggatgtggcaagaaggctccaacagcacggaaagccagtgagaggccaggcaagatgacaagcatttgcactgtataagtgagcttactaaggagttttgctgaggtctgagacatcagagttagacagtaaatgagaaatgagaaagttcaaggaactaggttatgagaagttggtggagacaatggtaaactgagagtcagttggaccatctggggaatgcttagagaggaggaaaggaaaggaagagagttctagaaacaaaataaagcagatgaatctggtacaggaaaggaatctagctttagatgagcaggagacgcctcttagctgagccatgatactggaaagtttataagtagtaaggtagggttggcgaccatggcctaaaagacaccacaatcaatagcctttgtatatgaattagagatacttcacagaagacagatgtggagcgaggaggtttggcaatggaggcagtttctagggtttaggcataggacacaattgggagaacagtgtggaagccaccagagtctaggatgtcaagcacttagagctttaggacagggacttcatggggagtcttttttttctcccaaactgacaacaagattagagtgtagaagggaccactgagtgaggtgctcttggtctgcattcggttggtgattggagtcatttctgtcaataaagggtgggctgaggacaaccctggctgtgtcaacaactctcctggtagtgacagggcttcctctgagaacaataaagctgagggagggaatggattcatgttgtacagtaggtatataagatatgaacacatcagtacatatgatagttttgacctgttggctattgggtcaaggagtccttcatgtttccgaatttctttgagctcagaagcagagcacttacttagcatgcataagaccctggtttcagttctcagcaccataaactcacaaagtgagtaacaacttattggggaaaatgagtagaatttttgaaatgctgtgtcattgaagacaagatggaaagaccctttccaatatgaccaacgagatgaaaagtctgcatttagttccacggtttgatttttgacatgctcctcatgagttcacatgtttgagcgcttgatccttagctggcagtgctgttttagaaggctgtggaacctttggggcaggtgggatggctggcggaggtgaagtgttgtgtgcaggattttgaggatcatggcttgccttgcatgaacaagccatgctgcgaacactttctgtcacattcagtcactcagccattgtgctcttgggctacaacaggatttaatcagagagcctgggcccaatcacacctctctccctttaagttgtttctgtcagacactgtctcagtgatgagaaaaagctgacaaagacattcactgaattctctgtcacttcctgtggatgctctggtaaatcaccacaaaactgttggcttaaaataataaaagcttgttctcttagagttctgcatctgaaattcagaatcaaggtatcagttaggtccttcctactctgaatgctctagtgggaatgtcttcattgagtggggttgcattcatccagtgggcatgcctttatccagtggggatgccttcatcaagtgggtatgccttcattgtctcttctggcttctggtggctgcaggtgtccctgacttgcaatggataattccaggctctgcctccatgtctgaacagacatctttcctgtgtttctgtcttgttcttttccatttttcctctggatttatgtctgtcctttttctgtttcttataaaggaacatgtcactgagagcccatctggataatctaggatgttcatatttcaatattgttaacttaattatacctccaaatttttagctacagacaaggccctacaggttctaggtgggcatagattttgtgcaggagcaaaccccctagttactacagattccaacaggtttaaatcttctgatctgtgaattagagtatctttccaaacatttctatacatttaaataaaaaatttaaagtatttatatgatgtattaatttattatatggaaacacatatatatttactttaggtttcctttcccttccccacaaattgtgttgagctctcagtgctcagtaattaggattgagatttgtgtgagtatcttctcaaccatatgccaaaaataatagatattaatataaatgttaataatttggcaatgtctagtttcatctatagcaggcttaatccatggctctagtgtgtttccttgtatttaagaagtctaaagagggtctagagagatggttcagtggttaagagcaccagattgaatactcagcccccacatggccctcacaagaatctgaaagtccagtttcaggggctgtgatgccctcttctggtctcccctggcactgcaggcacatggtacacagccatgcaggcaggcagaccactcatacgcataaaatataaataaataaatcttttacaaaaaataatactaaaaataaaatccaagaggcagcaacacacaaagcttcttatacttcctttatggcctaggcttagttatgactctcagagacgtttcaataaccttcctttgcctttggagacaatgattgacaaggtggatcaaaagtttcagaattaatataaaaagacccacaaagacacacctgaagctcggcagagcttttcagcagtgtaacttggcccgtgtagcagcccatgaattgctacgtacgcagacaggtcagtgattggcacgagctagtgaagcgatcccagcagcgtgggtttctgctacagctgagtacagcatcctgtcaacagactggagaatacttcattaaaataatggaaaccagaaacatttttatgcatggtaatcacaaaaatgtgtttctcatgccttctagtgataattttgcttatgagtctcaactatatctatgtctagtcattaattctcatttttttactctggtctccaattgaaaatgcttagagagtattcctaacttcaagttttgccatgtaaaacacaaattaattttatacaagaactccagaaatctctccccacatctcaatttctgctcctgatgttacctcttgcagatattaagtttctcaaattaacagcttgttacagcagagaaaagccttgaatagttgtcacgatttgaaaacagtttagtccacacaagaaagatgtgtgtgtgtgtgtgtgtgtgtgtgtgtgtgtgtgtgtgtgtgtgtgtgaaggtgctcatgtgtcaggggtcaaccttggacatctttcctcaggagccgtccaccttggtttttgagacagagtctgttactgggacccaggtctcaccaatttgcctaggctggctggcaagtgagccccagggatcctccaatctctgcctccccagcactgggattttagacatacacactcagtgggctttctacatggatgctgggattgaccaaaagtcctcatgcatgcatgggaaaggctctgctgactgagaggcttcccggagtccaggatatttttattcatgtgcagaatgaagactttgggcctgaagctagactacttactcatttacctaacacgtacatttgtggcatctacatgtgccaggcaggtgtctgggtggagtgggggtggtacagggcctcctgggcagttctgatcctgtgtgggtcttttaccaagcctactaactctgcttcagcctttcttcctctcatcagctgccgtcatccaagtcaaagctgggtgcctcccagggtctcccaatctttctggtctccctgtcttcagccatgctcatttgtgtagtcctctcaccgttttctcctccagacctgaagcttcctggtgctcctataagtgatgccgaagttctgaggctgtcgtcaaggtctttggtaacttctcttgattctcatgtctaattttatctctaccttcccacatgaatcccaccttttgtcattcttgtctccccattcttctaaaacgcatttcattctcacttgctggggccctcctcgctgctttccacccacccctaatactgtaagtctccaacaaagccacagactctccaggaagacttccctggaacccacaagccatccggttattccccagttactttctgaggtctctactctggaattttgtatgtgtattggtgaatattttttgtcgacttgacacaagctggagtccatcagattgtccagtaggcaagttggtgcatttcttgattaatggttgatgtgacagtgtcaccctaggtcctgagttatatatgaaagcaagaaagacaagcaagccagagaaagcaagccaataagcagggctcctccatggcctctgcttcagctcctgcctccaggctcctgttttagccctagtccaggattccctcagtgatggagagtgacctgggagttgtgatgtgacataagtcctttcctccccaagttgcttttggtcattgtgcgcatcacagcaacagaaagcagagtggagtatttggctacagagtgttatactgtcttcccttgttacatttaggtctggcagcttcagcacatttggtgtttgtttgtttgttttttatacaggactaatgtatcctggaactcactatgtagaccagctgagccttgatcttacagaggtccactgcctctgcctctcaagtgctgggattaaaggtatgtgcattcgtgcctgacctatatttggcagcttttaatcaaaggtcttggaacagcgctgatcacaaccaggagcacaagagtgaaatctgagactgaattctcaggtctggtagcctgagttctcagcaagacctctgtccttctggctgcgtgatcacagataacttacttaccctcacctaactttcatctccttatttgcaaacttggatgctccaggtactcactactcaatatgagtagttacttgttacagtaagagaagcagggtccttaaaatagaccatggtatgtagtaagagctcaggaaatgttagctaaggttatttcctaagaaccatgtgtaaattaaatgcaagccctaggtatagtacttggcatggaacaagcgttcagtaagtattagctagtgctattattgtgtttaacatatgaagagggacagtagaaaaataaaatagctatgattattttattgacaaaaatatttaaaatgtatgggctagacttataatgatctctactttgtgtgtgtttgtatccaactgtatgcattttcctgtgtatgtacatgtatatacacatgtgtgtggagatcagaggacagtcagcctcaggtgttgttcctcaggtaccattcatccaccttctgcttcatgtgtgcttgtgtgtgtgtgtgtgtgtgtgtgtgtgtgtgtgtgtgtgtgtgtgtgtatgtgtgctcgtgtgtgggtgtacacatgaaagcatgtgtgcatttatgtggagctcagaggacaactttgggtgtcattcctcaggcacctcaacatttttgtttgacttgggctttctccttggtgcagggctgagtcaagaagactagtcttggggctggagatagggctcagtggtgaagagtgcttcctgcgcatacagaagacccaggttcagttcccagcacccatgaggtcactcacaactgtctgtaactatagtctcagggactctaatgccctcttctggtctccttaggcatcaggcacatgtgtggcacacatatatactacaggtaaacattaatactcataaaatgtaaagaaatacatcttttaggaaaaagcttagactaatggccagtaagcttctagtgactcatctgtctctctcaccatcattaccactgaaattagtagaaagttctcctgattttttttttttaaacatgagttgtggaatccaaacgtagggtttcacacttatgagtcaagcactttgctgactcagcccagacttgatatttgagacaggatccctcattggtccttagttcacccaccaaaaaggccagtgagccggagggatccatcaatttctgcctcctcagtgctggaccaaaagtgacattgcaaatgactttttttttttttttttttttttttttttttttttttttttgacaagaccacacctctgaacagcacacacttgccagggcaaacactttatagactgaactgtcttcccagccccatgatttctgatttttttgtttgtttgttttctgaggaaattgaggtttaaagagattaaagtcacataaccagacacaacaaaaaaagatgaagcactcaaaagaccatgggaaactcttcctttaaaagtgcccgtactgtgctcctggtcctggagcaggcagtgtggagaagtttgatctaacagtgataacaaaggtggggtttgggttcacatcatcctgcttccctgcctgactttacctcttcctcagcaggatatttaatcctgcagagtttgcatttccttgtctgggagatggagacagtaatacctaccttgtgggccgtggtgggaataaaagaggtaacccgagtcacactccctgcagcccctggactttagacaccttttttttttttctttaaaaatttgaacaagactccatttaacctctttaattagtctgtgagatgaactaaaatacaatatgactctgggaggcagccaacaagactatgcattccattgcctggagtttgtgttataaatagacaaacatggatggtattaacaacatttaaacacctggctcaatttacttattcatagccactgttcatgtcatagttcctattggctagaattcttctacaagttgtggcatgtcctggcagggaaagtcttttgctaagcagttgggagtgaggaaaaaaaaaaaacactgaggttacaaataagttgggaatgctcattagggcgtgtgaggtgctgagaatgctgggtgtttgagtgagagcttcacagagactcttgaaggtcagacccctccctccctgatgcacatgccacaggaattttccaaagattgttttattttagtctttggactgagttggcagtgtcacaatctgtggttgaaaatagcatgaataattaggttagaggctagtgaatgtcccgagatgttaataacattaccaggaattcatagaggaatttcctccccagattcaaagatccctgagcaggcacaacttacattacagttgaagccggtgaggaaaacacctgcacatgctacagtgttccagtcagctgagtggaggctatagtttccttcccttccttcttaaaaatttaatagagatgtgttaccttacagagcgtgtaatccccttcagcttcacagctccctcctgaaggacaatggctagcctggtttctctgtgctttcctgttccatttctcatttcaaagacacttgataatagatgtcactcccattttatggggttaatttaggaataaagtgatttcctagatacatcttaatgtcttagggtttctattgctaaaaagcagcaccatgaccaaaagcagcctagggaggaaagagttctttcggttatacttccaggtaacagcccatggttgagggagatcagggcaggaacacggacgaaggagcgtcagcagaggccacagataggtgctgcttactggtttgttttcccaaggtccagaatcaccagcctaaggttggcaccacccacagtgagctgtgcccctctacatcaattgccagtgaagaaaattccctacaggcttgtctacagcctgatcttatggaagcattttcttagttgaggttccctcttcctagatgactccagcttatgtcaagttgacagaaaactatttagtacttgcatcagcatatttgaaatattttacatctgtgataaatggaagcatctgatcctttagaacaaaactcttgccaagagtgtgacacacatttttaattctagcacttgggaggcagaggtaggcaggcctctgtgagtacaaggcccactgggtctacaacaaggaattctaggtcagtcagggctacataaggagagcctgccctccaaataagtaagtaaataaataaatgagtataagactctaataatagctacttgattgaacttggctgactttaccaaattgattaaacaagtagggtcctaatgttaaactgtcagagttccgatcttctctgtccctcaccagccctgtcatctgggagtacccgatctgtctgagcatcatctacttgactgtgtcttagtcagtgttctattgttgtgaggagacaccatgaccaccaaaactctttttttttcttttttttatttgaattagaaacaagattgtttttcatgtcaaccccagttccctctccctcccctcatcccctaccaccccccaactaaaaccatacctatcacatatcctttctgctccccagggaggaccactgaaactcttacaaaagaaaacacttaattagggctggcttacagtttagagttttaattcattatcttcatggtaggaagcaggcagacatggtgctagagaagaagctgagagttctacatctggatctgcaggcagcaggcagagagaactggcttgagcttctgagacctcaaagcccatcctttcatgacacacttcctccttcctccaacaagaccacacctctgaacagcaccactccctgtggccaagtattcaaacacatgagtctatgaggctcattcctatttaaaccaccacaacagggttacacaaaacagtggatgtcaagccctaacataatgtctggcatagcattcccctcagtgtcagctatttttattgttgctaatatcactattacaaaggtattaattaccttctcactatatctcaatatatctgacaataaacaactccggaaaaaggtttattttggctcatgattgagggggataaatggatccatcatgttgggaaatggacagcagcaggtgggtgaaggaggtggtcacaggttatcttcagttaggaagcagaggtagactaaagctggtctcttccttctttagtctggccccccagcccatgggatggtgtcacatgaattgcagggtgggtcttcccacctcagtgaagcctctggaagcagagacacccagaggtgtgtgtctcccaggtgacttcaaatccactctggttgacagtgaagagcaactgtggcaaggttgggctttccaagacagaagcaaagttctatttaaaagtcctaaacttagaataggctaagtatatcctccagaggaaacctgcttctctgtaaaaagataaaacaaataaagtggttagatgggacttttgtgacaggaatggcaaggacatccacaagggaatgggagccactgattggtggatatggcttctccatgatctctgagcaacatgaagagaagttaaggttagatttagtcaaggatgctgatccttctaaaagtgatttggggtttctgttcagtccatccaccagtccatctatctattcatttatccatgtttgtctgtacatctcaacatttttggtcacctattgtatttcaggaagtaagcattttttgagtctacacagatgaccaaagttaagttccacctcttatgacattttcagactagttaatgagctagatgtggaagcaaatgttcttaaaaataacagagatgccaagaggactccggagattattgctctcatttcacctttatgaactgtaagcagttggcaagtgtggatgtttgaatacagtactttgagaaaaagtaagcattgcacggagcatcgtatgggacagttcaacttcagaagagagtcagtggaaactaccttgccctcaagactatacaaaaagaactccggagcatcttggtgcagactttcaatgtgctgttttctcaaagagggttgaagaacatggaagacttgctgggattcagtgttctgaagtatggaaaacagtgtggagtgttacacactgtttgtgtgggctccagggactgaactcatcaccaggctcacacagctaatgatttgacccattaaaccatctcccaagcccaagcatttgaattttgatggaagaaagaaacagaacaccactggctgagacgaattgctgtttgaaaggttaagatcaatctagcaaaatggagttaattaaaacactttgtgccgagactcatgaaattttcctggtaaaataatttctgtgtttacaagtctgaggcatgaccttggatatcatctccctgagcacaaagaagggtgattagtgactcctgttccaaaaaggtcaaaatgtttagtagctaaaacaaggctcttttaaaatttaacaaatttactaatagaccagatgagggactaaataacacataatagaaacagaaattaaagtcgctgccctcatgaactcacagcagttgtggctgcaacttgctctgtagaccaggctagtcttgaactcacagatatctgcctgcctcttcccctgagttctgggattaaaggtgtgtgcctctactgcctggctaggctgggaggcacactcttagagaaaatggattctctcccactgagatgccatcaactatcaatagttcctcaactaggggtgagatggggcctgacctgctcttgttcagtcttatgcagttcagggaagacatttaataacttcagatttagggaagagacaagtcatcagatgctttcaatgacagacccttgacagattcgcacatatcctaccgcttgccccatactgaggtgaacgtccttatattggcattttaactgtaagggaactaaggctcatggaggcatggttgttaactgacaagcacaggatttcagtgcttgagtctctgccttcaaggcaaatactgctatttgtaaccaccctctcagagacctcaccagagcgtgtctggagtcatgcaggcttatcgccggcagcgggcctcaaaggtacaatccaaagctgtgactgttgaggactgggtgtctgtcatctggaggtgactgaagtcatttctctggccagtgtcagcctttggccagtacctcccaatcacaggtgctggggttgacaccccaggcttagccagataccaaggacagagtgactccataggttggaatctagggagggaccacactgcctggtgattagcaacttggccaatcatctctctgcctgtgtgctttggtctttcaattcagatggattaaatctttggcagaagtacttcatcgtctccgctatttcttcattcaggagagactttcacaagcttcagttagaggccagtcaatgtgtctcaaatcaatgtctccttcagacactactgacaggttttcacagtctatggattaagcaccactgcaaacagttttttatatttttccttgtgtttttgtctacccccttcctgcccttctaactcccccatcataccctcaaatgcactccctttctgcttcctctttattgtctttcctgacaacctctcagaattgctgttgattgactttgtcagccccataacacaggtgcctgtgctgagtggactttttcatggcttcttgggtcaagatgtgcaggaaatgctaaatgtaccacccgggtgtttgactgggcttccatacttcaagtcaacattcccggattcccatggatcacacaccaacccaggcctgaatacaaatcatactgccatgttcttcaagaggtgtcagcattcatgaaaactgaatatgagtgagccactcttatttttataatttcatttaaataatatagttcattatcataaatttacatgttactctcttgcaaattcagccataccaggcttagctccaagcaaaaagtttaccccttatgaatattattttcatagagactcctaggaaggacatagattatatttaaatattttaagaaatcatttattttcagagaattcagagactttgggagtgtgactatttgccctgttcccaagatgctataaagcaggcatggctgggctggctgggccggccgggtgtaaatcatttgtttatcagccatgtgcacctgagtgcctctcccctgcctcttctagttatagggacttagacacagtgaagcctcagctgtagaacatgtcacgtgagagcacagaagaggatggtgacaactgtccagacacatgacccccaaaacaaaagacatgagggaggatgcaattgatttgaccctgaagagagttttactcttcaaacaaaacagggtcttctgctgctcctgaggccacttgccatgccactagcctggagccaccatctagttttgtgtagaactgggttcttgcaggtgccaccactcagagggccaccagagggtgctttcctcctttcaggttctgccttactgcaaacagctccttttgctcaatagcactgaatttcccaggcattggggattcggcagatgcagctgtggcagacagcttgggttctgggcaagagaaaatgtcaataattgtatgtgtgtatttcttcactctgtctcttctggtgaactgtacgcttaagtacgaggtttcgtctgtgtttatccctctcacgtgtggctaggccagagtctgacatttaagaggtcttgataaatattacggagtgtgaagaactgatcttgacttcaagtcccagcttaggtttcagttttctgcctacctgaatcatctggggtcatcttggcttagcaccctcattcagtaggtctgggatagggatgtgaatgaatctttggaaagctctgtgctcttagatcactgttgcttcccctcatgtgggcctccttggctcattgccccggctatgggctgctgagtatgagcaatgaatccctgctccttaggtctgccactgagtccctttagtgtgacctagtcctgccctcccatctgctttttggtttctcgtcccatgtgtacccttccctgccagagatgtctttacctgctagttgtggtagaccaactgagaagaccaggggcttttggcaccactcacagggtgtagcctcttctgaaggttgcaactcaccagctcccttcatgcttcaacccatctttagacaacatggatgctagaacagaaggcacccaaaattaagggagtactttttcttacagcaaaggtttatagtattgcttcctcagaaatcccattttccagagttttgaaggagaaatacatgtgcagaaatacatgactaaggagagcagctttggataccgcagagtccccatgttatgtgggttggcactgtgtgagtagtgcagagactatcagccttttgagtcaggtggtactgcataaacctgagggcaaacctcgctggcatgtgtggacaagttgggtaaccctctttgaacctcagttgcctcattggacagtagtagtcccatacaggttatatgcagatttggcttttgtttcaaagctgtcaacatcagtcattataagcaatagcaggtgaaatttgtgtttgaaactgttgcaggatgctgtgtaatttgtccttgtgtcctcttctcatttggccaccatacaagaagactgtcatttctcttcctacactttcatcatatggacctggtgatgtctacaactgacagttttcccttctttaacccagctgttggaaagcccagagccaaatgtgaggtcagtcagcatcaactgtgcacatcattaagatgttttttggccgcatgcgtggctctgttacatgcttgccatttcaaaaacctgctctcacttttcagtgatgctattatgtattattattctacagatcttaatctttctgaaataagacagaatgaagtaaaaaatgcatttgttactatgagagtgagtacacaaagttagagcagttttcacaatgtctgggcactaataggctcatgccatacaagttagttttatgtagtccttgtaaaagagtctaattaccctctgtgactctgagttggtttcttatggattcttttagaagggtgtggtcaagtggttctcatcacagacaggtttcccaagctggaaaggtgtgatctcgttagctggtgggaagtgtacttctaaacacactggcagcccgaactgtccaatcgctgcagagaatgccttgtagatgagcccggactagaacaaaaataacccaagagttatttcaacctatatgagttcctcaaagtgcattaaagtgggttcattcttttccagctacacatcataaaatcttgtttcttctcctttctaattccctttcactcactatttcccaactttctggctgacgagattcacccccctcccaccctaattcccagctcttagtgaggtaggtaggccaccaggcctctgtgattagactctctgctttctcacaccttcctggatttctttcttactccccattctctgattccatgtcagacaagatttatgaagtgagctgacaaagacaattcctttttctgagggggttggagaatcttcacaggttaataaatcttctgtgtcatctaggaaataaaggctgattaatatatggtggaagggaatctggggcatggctttaccactaaataccttcagtctgtgggatctggaggaagccattgaagtggaggttgcagaaattcacacttatccctcttctgcccaggcctcctttgttctgggacgggaacttcatggtgcccatcatctgaaagtagagtcacagtgagcctgtattggatgaggctgaagatattgaggacaaatttggggaccagacatgacagtgaaatatccacttggtttctatggatggtgtgggaatggctacattggttgtccctgctctgatggagtaaggaagatgggaaaactccaaactcattatacccagtttcctaacaggaataaaggtattcatttattggctagttattttcttgctccaagaaattcagtaaatagtatgtcatgttcttcccaagccatatgtttatacatgtcacatcaactttggggtccttggttaatctgcagtataaagatcacatttgaagaggaccagatagaatgatagattggttcaggagatggacaaagaaatattaacctagtataagtgctaactaacacggccatttgaattgaacttagaggttcaccctcattgtacttcagttcttttctttgtgaatatctactgaatgtaactgtcagttgtgttaagtaccaaggagattacgatgttaagacactggtctctcccctaggaacaaacacatgtgtacaagggataattagagcacacgatattcgatgctatgactggaatataaacaagatgctatgggaacctacaagagggtgtgactaacttgacctaggagagttaaggagtaaggaaccctggagctgaagtcatgcacaagaggaactttgctcattttctgggttgtattgtctagattttagtttgatcacactgccccacaaaaattacaaaacctgttttagccaaatatggtctcagcatttggtctttgcattctacagttaataactgaccatagtagtatccctggaatgttcttcagagttgaggaatgattaggaggatttcatacacagtcagagataaacattatctttggagatagcagagacgtgttctgatttctgagcttcatcttcacaggtagcttgactatttttggagtcacttagaagacatgcctctgggcgtgtctttgagggaagacttaccttgagtgcaggcagctttttgccaaggactgggatccaggactgaataaaaaggataaaagagggggcctgttgagcactagcaccatccctgtacctcctgactgctgcgtcttccctgccatggtggactagagtcccatagacagtgaatcaaaataagcccctccaccctttggttgtcacgtgtcaagcatttgtccacagtaacaggagaagtggcaaacacacccagtagaatgcatagcaaaggggaaggacactgactctgaagcaggcctgtggatgctctagattcagtctgactggatggacattgctgtcactggggaatgtttagaatgtcatgctctgtacaaacagttggaattcacttcaaacaggagcaaggttgttggactgcaacttcaactcaaggtcttttctgaaggttgcatcgtggtctctaatcagaaagggcaacacgacagttccctctttgtgtatctaccagctctccaacatagttcttcccagcttttagaaacaaattagaaattagtgtttattataaaaatgaccatcaaatagaaggttttcagtaattaaaacagttggaagccaacttttagactaacagtttcagtacagtttactctcaattttttcccaacttggtttcagctttaaattgggttgttaggatcctaacaagctcctccctggtcctaagtgcagcatcttgcagagtgccacactattatgggcctcgattttcagtagcattgtggaatccatggcataaaaccattcgtattctctaagatcttaagcaatctttaggaagaagccagcttcctcctcttcagttgtatagatgtggttcttgtgtttattatgctgagttactgtagacagggctagttagagtactggctttggagccatagtctttgttcttcccggcttattgacaaatcatgtggccttagacatcaaagccaatacttctgtgctgtttttcttaaccgtgaagaggaaacaaagatgtacccaccacagaggtgtttgggaggacgaatcaagtcagaatagttaaagcccttacgacagctctttgtagcagcaagtgcttcagacgtgtaaacttctgtcatgagttcacaagtcatatgacattgatggactccaatgatcatgtgttcctaaaataagtctatgtagtttgcatgcatatgtttactaatggtagttagaagccaggtataatttcagcagtgtgggagctgaggaaggaggatcaccatgaattctagaccagcctgggctacagagtaagacctcgtcttgaaaccaacggaccaaaacaaccaaccaaccatttaaacaagcaaccaaacaataataaaaacaataatgagaagattttatttcagtttaaaattttatttttattttaaaaattatttttatttatgtgtatgtgtgcatctgtgtgaatgaatgccacgtatatttgggcagaggccagaaaagggtctcagatctcctggatagagttaaaaggggctatggtcccatccatgtgggtgttgggaactgaactcagtcctctgggagaacatcaagcacttttaaccactgactcatctatctctccaaggattttatcattagacaactatactctgtgactagttacttagaatgatggttttattctttcaaccacaagggagaacaaagtcacattatctagaggggaatggatgcaactggaaagagattggtgaataagtcagtctcagacaaatattacatttttttctcatttgtggtcctcatatttcatatacaaaaatttatgtaaaatatgcaagatacacaaaatcatttatgtatgtatgacatgaaagtacaaataaattcgtccagggaaccaaagcagactaaatgggggtggggcggggtgggatgtgacctgtgggcagatgtgctccaagtaccttattattaaatgaaaatgtctttagataaccccctcatcgtgcatgatggatatacaccaagaaacaaacaaaagaatagcggtgtttccgagaagacagaagcaggcagtgcaggccagctgctcaagctttgggccacctccccatgtatcaatgctattatttgacggtcaccctggtgactcatctagaaaatggaactagtttctcacaagaccatttagagaacaacataggaacgcttgtggcatgcactgaaactcagaacaactgtggggggagatcaaaggagaggtggagcaatctacagccaggtctgcttaagtatgacttggttctttgtagcaaggcagggagatgaaatctcacacaggacaacaggcgctggagcagaggaaaacattcagcctttctcactttaggaatgttaccaggtattgccaaacccaggacaaatggcaacatgtggctgtcagcagaactgtgcgggtggacagccctgttcagatgagtcattggatctgtcctgtcttgtccaggaactccaccttcatatgatggggtgacattgtggggagaggagaaacagcaggctgaagatctggtctgggaacaggcggcccctgggccatgctgtggtttgttcagttagatggtgtttacaagacctgtgtagagcctcagccacagaaaggctgagtcagtgcgtccttgggataggcctagactcttctatctctaagctctgtggcttccaaggcaggtgctttgaagactgcatatggagaagggtaactcgggtgaggacaagttgagtaaagccccccagggaaggccgctgctctcttcatgagtctttcctcaaaaaaaggagggaacaacaacaacaacaacaacaataaaaacaaaaataaaacaaaacaaaaattcaaaacaaaacaaaacaaacaaacaaaaaccaagcagagaaccacttttgctttcttttgtggcgaagcacagcctactaacctgtgctatttctcttgttgctgtatgggtgcacttctcaattctgcttgatgtaagaggaggtaggatgcaagggtggtttctttaggggacagtgtagtttggtgtgagcatgaattaatggcctgtgttatacaagtccttcaacttgtcccccgaccatctgggtgttgctaaacacatctgttccttctcctgaaggatgctctaggcttgccacatgatttaaactacgctgagagacaagctccacttgtccacacctctggtgtgtagagagatggctctgaagagcctagtttgccgtgattggcactcattcagagccccggtttttaactctgaattttgatttgggcatttgcctggggtgttagtctgccagggccttcccagtctgttctctgctgtttcactcctaaagatttacagctaatgaagggataaagaaaggtcacgggtgagaggcagcagcatgtggtggtgactcactggctgggcctggtgtggagccagtttgggtggaatgctctaggctgtgcctgctttcatgtggctctcagccaggtcccggcaggaaccagtttcttgcctgttcctggtcatcgagaaagcttgactcttttacctgtctcctgctgggatgggcttgggtcaaagcaatgaaacccattggccatttcacaaagaatccaacagttgagctctgaggcaacgaggaggcagtggacagggcagtcttaggaggggtcaggcacagagacgagccaccagccagtcaccatagcctatgaggcacattaacaggaggatagaaggagtccaagtgagcagccatgaacagacacaatttctgagtcttggcacgactgactctttgaacgaaggatttttgcttgtaggggactatgtcttacatcacaggaagtatcattggcttaagaatccctactgccatctctctgtcagtgaaactagcaaaatcacctctgactgagaaccactttggtgtggcaatcccaggcctgtgccagcaaaggttgggaagatccatccattgcaaaaatctattgggcactagcaatgtgacaagaactttgcctgcatccattacctcatttacatcacattacagctgtgagatgtggaaagcctttttgctccattgtagggataagaggccatatattcacaaaaatgacttggatatcaaggccaagcatcgaggccaagcctgcctcaccttgctgtcttccgtaatggagctttaacttaggaacaagtgttgcaattcaagatgcaagccccaagctgttattgtggctcaaagatgctgccagctgagttggacccactttggggctgagtacaagcaaatggatacaaaccctgtggaggcagcaagacatatattctgtaggtgaggaaaggaacctgaatgtcagctagatagtccagacagagagcctctaagagataggaggttgtcacacaagcaaacctttgcccctgccctgctgttttcacccatccatgagtcatgatccctgcctgacacatgacatggacatgtactcagatctgctcttttttttagttcacacattgctcacttagtctccattttcccctttgctgcctaagggccctgacagcaagcctgagctttgggaaaagccatggaatgactgcaacatggggtcgatgatgttctgtgtcatgataatggaagctagtctgaagtctagtctgtgtacaacacctggagtttggggacgctcatgacttcatttaacatcagtagatggcactcaccctaggaaaggtatgtttagcaataacagtgttttggggggaaaaagaacacagaggggatggaacataggggtaggggagagtcagtcttaaaatgaagtgttgtatggaaatgaaatatggaaagctgttactttcaaactaatttaaaataaaataaaattaaaagcataataataataattattgttgttggtttttttgagacagagtttctctctgtagccctggctgtcctggaactcactccatagaccaggctgtccttgaattcaacctgcctctgcctcctgactcctgggattaaaggcctgcaccaccactgcccaactgcgtaattaatcatttaaaagatttcatttttatttgtgtgtgtgtaagggagggcatgggtgtctgtggagaccagaagagggtgccaggtactcctggagctggagtcacaggtgattgtgagccgcctgatataggtgctgggaactgaacttaagttctctgagggagcagcactcaacagtcaagcagtgtctccagtgtacacaacacatttttaaaaggaaagtgtcagggtttctgctgtagattcttcagttaccaaaagcaccaagtggcagtgaggaagctgttccaggaatcaaagtgagcttctaaagggaacaccaaggttgtgtgggatgcagttgtttggtgaactggtggatactttgaacacagtggcctttggtgtggaaaacaacattatccaagtaggactagcttcaaagacatggctctggcccctatccacactcaatcatcaattaaactcaggtgcagtgtgaaaaccaggagcaggtttacaagagagaaggttctggttgagttgcaaaggatcaacctgagacttgctgctcactgcctgagagttactgatgtctctgagggacatcttgctcagcacaatcactatgcagttctagcatttgcttgaaagcatccctgggactatcctctgttcttaatccctcttgccctctttttcagccttgcccttttcctgggatattgaagctggtccttttggttcattgaacatcactaaatagccaggctgctcaaatgaaacctttggttttgcacactttatattatctttaccttatgtcattttcaatattagaaaaataatacatgggtgttgaagaaaaattagaaaatgaaatcatagaagcagaaagaaaaggaaagggcaaaattatcttgtaatctcataacccaaacagagcatttgagttatatattcttgtttttgttttgcctttaacaaaaagaggggctgggagaaattgttagaagatgtgatattttctaaaaatttccaaaactatgcttttaagaaaggcctatggattgcttggcaaataggcctagataattcttaatggtacatatcattttggaaatataaaaagaaatgcacatgatgaaggttgttgctaccagatactcgtgtgtgtgtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgtgtgtgtgtgtgtacattcgtgtgcaggcctgtgcactggcatatgtaaatgaactgtctgtggctcctgaagaagaaattctgttgctaatttgctgactcactgccaagctctgctgcaggcagggagcagattctacttattcaagccaagcgtttggccctcatggcttattggctactgtgacagacttctctcactcctcacctcctccttggcacatggatacatgaagcgttttgttcattttacctcctaatctcctctcattttttcaattactcttcaacgtctccagaattcagatcatctccacccccactcttctcatgtacaaacctaggaatatcaagaagcttctaccttgaggccactgcagggatttgcgttttttgagtgctgtctaggtatatgtgtgctgcttgggctctgggggtgccacacacttgacattgtttgcaagctccaagaatagctctctatttccttcccacactcaaaatacaatcagggtctccaattgagctcaatttttggaggtcacacactgggggtgaggggaatagacctgtgtggggaggtaatggagaacaaacagcccacctcactgtagaattcctcaaaattcaagtaaaagagaacttaacactgacatgaccagggacacacaatttcaaaaggttttcacaaggaaacatttgaagctggttgatgaatactaagcactgggcactgtagctgccttaaaggatggtggggatggaaggggactggggaaaagtctgcggatggagagctagttttccagttctatggggtttcccctcttccacactgaaatatttttctggtatgctattgggaaagtcggaaaggctcctgaatcaaatgaagacaatataatcacatctaagttgcagatactgatgtgagcatccatcatgctcacattcatttaagtacttcaatatccatgagggagaaccaatcacttctgatttacagatgtaaagacaggagactgtaaaccttcctgaggtcacacagcttagctaagctgcagagtcaggatgcaggtgactctggtgcaccagagaccacatgctctgttctacctcctcttgtcatgagagtagtcacaggcttctgagctctagtcagagttcttctcagagaagtcacattggctcaccgggtttcatatttatcatttaactaaaaatggtcctacaaaagtgtttggaataatccttcccactcataaaatttttggacacatctggaaagagaattgcaatctgtctccaaggaaatctggattgcatttgtatccagctcttatttgggtctcagtctcaccactttctccacgagaccattgcaggatctctgttacaagaagaggcaattcctttggagctaccaatgtcattgggctagctctacttagccataaagatgtgtcattacaggctttccatgaaggatataaggggtgggtagcctgggaaatggggacatcatcatctaggaagtatactatccccagagcgatagtaggtttggaagactaggcacaaaactggccaagtaaaatgacctttcacccaatttgccaggtatcagcaagtcatgtggacatcaggatgcctctctttgatgaggttgatatataaaggtttgaagcattatctacaagactctgtaagtactgccttctaattacctcagcctgggagcctccttccgagcatctcatctgtctgtctgtctcctgcacagtggatttctgacccttcttggtatccaaactcactccagcatttgggcagggctgggcttcagacactaatgtagataagaaggtaggaaatctcctttgatcctagcaacacagatcttcaacatcctgacagtagaatcaatgaagccctagtcttttggggcagtagtgattgcaaatgtggggagtaggatgcaatggtagtgactccatactttctcatcaacaataaagtaccgagagtcctgttctggtattaccataatcttgggaccaactttccaattctttacctctatcttaccccgtgaatatgtaaaattatctacacccatgctgtagtcttcagaaaaaaacttgcaagcctaagtttctttctctactcttactagacattccacaaatatttaaccgaattcctattctggcctgggaagtgtgcccagcagaaagctaatctttgcctggacaacagagatgctgagccgagatatggtgtggggatggagggcagagatattgccagagggaaagattggaatcagattttgaaaagaatcctgtgtcacattgtgaagtctgtaaatagtaagaagctcacagaagatatatatgtgtgttctacacacacacacacacacacacacacacacacacacacacacacacacacacacacgattcaggcttcttatttaataatgtcaacacatacctcttgcctcaaagagagtaagagacaatttgttctgtattaaataaaagtgaccatgcctgggaacatagattcagggttatccccaaaaccgtgtccaacgtggtgaccatttcatgaagtttttgtagcattggaacaaagaaactcataaatcaagtaaaagcatattggtagaaagtcaaacaggtgttcagtgaagtgaaagaatctctgtttccagccgtggatgtaatctggcaatgctcttggccttcgggttgatagaaggggaaggtcttccgtgcatccctgaaggatttgcctagtagctgtactgatggatcttgggtcaagtacagagggcagtgatggatggcgtttaagagtgctaaagttgcttcaaggtaacttggttccaagcttgtgacatgccagctttcatagccacaaaacttacagtggttactgtaatcagctaaccagctttgtggaatctttagcatggacacaacacctttttttttttttttctggtttggtttgggggtggggaggaacttcagtttaaaataaggttcagtttatagctcaacacaaatgtttgatcaacatcaattttgtgttgggctctgtgctgttagtttttgtcaacttcacacagactagagggaacctcaaattaaagagctgcttctatcagattgtcctcacatgtaagctaaattgataggtgaccaaattacaatatatcaactgctgcctgaaacaatgcctagaaagtcaacattttttccaattgctaattggtgtagaagggctctgcccactgtgggtgctgtcatctctaggcaggtgagcctagctgtataagaaagtagctgagcaagccaaaggaggaaaagtgttttccatagccagaaactagcatttcctctgtagtttctatttcaatttctgctttgagtttctgcactgagtttcttcctgtcttgccttggtgttggactggaactggtaagccaaataaaccctttccttgacatgttgtctttggtcaggatgtttcatctcagcagcaagaagcaaactagggcagactctatggtaggtaatagagtagaaaaacagtcaaccatggctaccatggtggggaacaggagactgaagtacaggacaaatgacaacataggaagcattaagaatatatgcttagctgggccatggtagtgcatgcctttaatcccatctctctaggaggcagaggcaggtggatctctgtgagttcaaggccagcctggtctatagagtgagctccaggacagccagagatacaaaacaaaacaaaagacagaatacatgctcacacaggctcattcttcaagggaggaaaaacatctaagcaggagaacagcattgttgaaaaacttagtagtagctagcagtggtagttcaccactggcatctcagttctaggacaacctgggctacaacaaaactatccttgtttgggtgtgggagatatgctagaaggtagaacccagggaagggtgactgcaaatttcctccaaaatgtcagctggcttccttccagggactaattctgtcgatttttcttcatttgacatgtgacagcacagcctaggaaatcccacctaatgggtttctttctagaatttagtagtcagcacccatttgcctaaataaataaaaacaacacctttctgctgcacggaaaggcttgttttacataccaggattttccaaatgtttccaaatgctttggggatatgtagatcagctggagatggcccagctaagccttctcaggaataaaaaaatatgattaaaatcattcatgccctcattacccttttccaataattcacttacggtttatacttggagatgcatatgctctcatgttacttgagtgtggagtggggaggcaagaggaccaggttctgctgtggagatcagttattaggatgtcgttgacttcagaagtcactctgactttcttccaggcagcagctgatattttgtagccttgtaatttgattggctgttacttagcttacatgtggggcacctgtgacatagatgcatggcgactaaatgtgctaattacagtgacatccggcaaagggagggccccattacaaccccattcaacaacagtgacagattgtcatggtagggttgttgatcatcagtgacatcaaaactcacaggctagaatgttctgggctgggttgacagagctctgcagatttgctcctatctaacagggctccctgtcatgactctccagggatggggctgtgtttgtttgatggggaggggcaggaagaaaaggtagccatggatgggcaggtggcttgagggaggcttcagatgggggagaactatttgccctgattgagcccaggcactgtggtaacttcattttaatttagaagtgacattctgatgtggcagtcagaaattatttttcattaattttaatttttttacatttaaaattgtatgtatgtatgtatgtatgtatgtatgtatgtatgtatgtaagtatgtaggaaaatgaatcaggatgaacacatggaggtcagaggaccacttggggaattctattcttgagattcagttcaggcttggcagtaagtgcctttacttgttgagccatcttttttgttttgttttgttttgtttttcaagacagggtttctctgcatatccttggctgtcctgaaactctttttgtagatcaggctggccatggactcgcctgcctctgtttcctgagtgctgggcgtaaaggcgtgcacccagccagctgttgaaccatctttcaagtcttcaaattaaaacaatattttgttaagtaatattatttttatgtgtatggtgctttggctgcatctttgtctgtgcaccatgtatgtgcctggttcccgaggcatccagaagagggcatcaaattctctggacctggagccacagactacaggttagatgctggaaactgactccaactagtggtcttaaatgctgctctgtctctccagcatctcagtaattttttgaacgtctacatttttatcttgaataatttttctttcttttaatatgtttgtgttgtgtgtgtgtgtgtgtgtgtgtgtgtgtgtgtgtgtgtccatgtacacatgtgttgaagcccaaggttgagatttaaaatcttcctgaattactcctctactttgttctttgagatggggttagtctctcagccaaatccagagcttgccatccagctagtctccctagtcacttgctccaaagatttcctgttgacacctctggggttgggattgtaggtcagggttgccacatctcctcctgagatttctctggcttctggggaaccagagtgcaattcatacttgtgcagcaaaagcactgtaactcctaagccatcaccctggctcatctttttctttccttaatcccaagaatccacctggtcatatcatgtatctcgaagaatgattttcaaaaatgacagcctgcatagagactcaagccttgagttttctttcgagcaagaattcacacattaagttaaaatggaaaacatttatttcagagtaagaaaaacatccaaggtaaaaagaatgcatcgtcctgcaccaaacgaaggtgtatttatggtgagtccaccagtcacatggagctttttgctgtggattataagattgtggttacacctaacattaaaaagagtgaattcatgattttcaggacagatggtatattttcttctccttatgcttgtccttaaatagaaaaggaggaggaggaagaagagaaggaggaaaaagagagggaagtggaggaagaaagaagaaaataagagaagttttggagcatatcccattgctccctccccctgcccaacacacacactcagaatatctgttgtgctcctctggctgtcctggaactctcctgtgcagaccaggctggcctcaaatttccagtgatcagatcagcctgcttctgcccccagttattgggattaaaggtgtgtaacatccctgactctggggcgcatccctaaatggagttacgtgtttaagagccaaaggatccaggaaaatttattcaccatactccaaatttagtgttttatctcttaactctactgtctgtgttgactgcctcagctctggaagcctacctgcaagatgttttggcagcaaaggaattcaatgctggattaattgctaaatcacaagcagggaactccagcattaaaaccaagcacaacataaaataaatgtttccatgctgtttaaaacactcattccaagcctccctttggaagtaggctggttaaatcaatccattaagaacagagggcctatccccacttgctatttggatacacttatgtggctctctatgcctctgtgcatggatgaggatgaatcactgtttcctgtgtgggacaggcccaagagcaagcacaccatggtaacagtgatcttggggctgttgttgagaactggggtgatctagaaatgcagccagtgtccaactgcaagctcttgggccacatccaaactaatggccacactgagccttcctccatacatttcttcatttcacaagtgaagctcattggatttaggggctgaaactaagaggtcattcatcattcatcctatggacagctgttgggtgcctataaattcttgacactgttcacggaggaaaggaataagcaggtgtatctgcaccaggctgtcattccttctaagttagtgtggcattgctctaggtgaacttcaaggaggttgggtgatcactagtaccttctatgaatcatacacatatcacgttaaactacatctttaaaaaaaatcaagtaacttgtgcacatgacttaagacaccagagtgctgaaaggttcacatggaaaatgatcagtacttttccttacttccaagggtcaggagtctctacctttagccatgcctactttgagttgcctgggtgggtaaggcctctgtgtctgaaaacacttctctgcattcttcctgctgtcctgctgtggtgggtgaaaacttagctcatcctctggccccattcctcctctcccgtgtaatataattatatcactatttttggctcttctaatggttactcttgtaacttggagtgatgtgcttaaacctctcttttcaactgtgtatcgacaggagatcttgatcgtccacttaggatgttgatgcttcccttcttcctgtgatgtttttctgccacctttaccttctagcttctcttaactgcaattttgctttcagagtgtcaaggctgataatatttacactccggttctctaatataattattcacaagccatttaaaatgagttgttgtagtgttgtctgaggacttgtgtcaagctgcgaatcattataggaaagagcctttctttaaagattggagcagtgttctggcctctttcctaaaggctgtggggcctcatcagtgatgtttccgagcacacacaagagagtctgctattctctggtatcagaatgtgtgcggtacagacttttgggttacagctgatccatgatcttttattatctcctccattagtcttttcagctctcatttccctcctgatgtttaggcctgaccttctatatttgaagccattcccaaagtagaagaatgtcgccttttgtgatttcatggcctcagctaacactgtatgttccctgatgtaccttttcctagctcgtacacttgctgtaaattccactttaaacagttctcatcccagttctcagttattcccatgaaagtgaaagcttgggttaatgatgtattaataataaatatttagaatttttattttcatcatgctagatacataccatggaaacaaagcaccattcaaaatgttgttttgaatatgttcaatttaaaattcaacaaagcactaatcaaaattcaatgcactgagttttctagattatctcatttaaacttcagagcaatttgaattcagatcggtcaaatagtttaaggtcattgctgagcatgtgataaacccatctaccttctctgacctgagactgttttgtgtccccttccctgcaagcactcaactggtgtaaactttcaccctggagaatttattgtaataatgtgaatcatacttgctgtgatatggatttgtttatttttgttctgtcctcagctaattaaaaagggatatgatatctggctaaagataatgattatggccaggcggtggtagcacacacctttaatcccaccacctgggaggggatgcaggcagatctctgatctctgagttaaacaaggctagcctggtctacataattccaggacagccagggctacacagagaaaccaagtcttagaaaataaatgataatgattatgttaaaattgtaagttgatgtcattcaatattggtataatagggcagaaaacactgaaacaactcagaagagacaaatcatacaatatagttcacatttccatgccaagtgtgaacgtgagtttgtgtgtgtgtgtgtgtgtgtgtgtgtgtgtgtgtgtgtgtgcacttgtgtttgtgtgtttgaagccaacatggtagttcccccattggcccttcacccacttctagccaacatataaaaccttttatttgaaaagttattatcagtgtgtcctttgggtttcattttgtttttttaaggagatatctactttgtttcttttgaggcagagtctcatatcatcctggtgttagctgattggaccatgctgtcaggccagtcatattctgcccatctccacctccctggcactgggattacaagcacacactatacctggatttttatgtgggtgctggggtttgaactcaggttcttatcctgcatggtcagcatattctatttctgtttcacaacttacttcaggatgaacattgaccagtggatgccctcatcccacccctgaccctggaaactgaggtaagaaggaaaaggcatgcctctttcctcaggaagtgctaaaagctaaggaggcagccaagcactccaggagccaatgctggaaacaatggattccttatttgtgttctgtatttatgtcagcttctacagcctttcaaaatgacaagcctatgctggttaagtgtgactctgttcctttaggttaactattttacagactacagttgccttgatctatgctaaaacataagctgtgtatcttataccttagccaagaccaagatagggtggccagtgtctctgtgccagcttgggagcactctagactttagacaccataagtgcttctctttgtagaaacaaagaaaaaagttcctcttaccttttgttagttaccttttctcatcaccatgaccagatacctaaggaacaacttgaaggagagcagatttattttgcccacagttttggaggcctctgtccatgctggcttggccctgggtgcttgggaaggatgccacagaagcaggagcacgaacagaggttttcatcttgctgtgaacacaaagcattaaacagacagggagtgttcacatgcaaaatacctccaaggatgtaccttcagtgacctacttcttcctaaagtttctagaaccttctaaaatagcaccatcagctggggctcaggcctttgacacaggaacctatgggggacatttcatattcaaacgaaaacacattttaatcagctaattttaatttccgctggaagaactaaatatataaattatatacatttagattgctcccttgtgggaaaaaaatctatgctctgttaattagcatgataagtttttcaaagataaccaagaaattcttttaggttaacacttatttgatagaatttcctgaatgaatattcattttaagatgtaaggtttgtctgccctttggtgggccctgtaggagaattttgtttgaactcacacaggtgtgtgtgtgtgtgtgtgtgtgtgtgtgtgtgtgtgtgtgtgtgtgtgtttgtggtttatgtgtatatgtatgtgtgatgtatatgtctaccatgtgtatatatgatgtgtgatatgtgtttctggttgtgtatacgtggtgtgcatggcatgtaatttgtgtataacaagtgtgtgtgtattatatatgtatacatgcttatgtgtggtgtgtgttgtatatatgtatgttggtgtatttttgtgtgtggtgtgtgcatatgtggtttgtactgtatgtgtggtgtgtgctgtatatgtgtgtacatgtgtatgtatgtatggtgtgtgtgttgcatttttgtatgtgttatgtgtttgtatggtattattgttgtatgtgtatatgcatacatggaggatttttgtggtgtgcatgtgtgtgagttgtgtgtctatgtggtggatctgcatatttgtgtgtatggtgggggtacccattaacttctaatcattagtacaactccttactcacgttcattattattcacttggttcctcttacagtatgaatagaagaaggaaaacatttatagatcacttaaaacattttactagaagaaagggaacaaattagcccacttgaatcactagctttgcggagaggaacgagcagaagatatatttaatctttcatcaaaggctgtatttgaagctcctaatatacagttgcacttggaacagcgctaaatgagttattagaacatttacacaggatcgtcattgtttttattagcggcattattccttgttcctttgttagagaaacaccctgcagtgtgtgcagatcgtgtttaattgcaatgcttttacatttcccctcaaatgtagttgacttattttataaatatttcaagtacataattgctattttgctttaatgaaaaatcacaaatgtatttagataacctaaggggtttgaatccatctgccccggagacacttatagaaagggtcaggctgactactgacttcctcaaccatggttctaagggagggtcttttgcctttgtgccctccctgtcatcgtgcaaagctgtggtgtttgacagatgtgggcttcaagcccactgttttctttctacttcctagtacagtaaccccaggcgagttctttccttctgtaagcttctggaatgctttgtgagttgacagagtaggataatactgaccatgccagattagtgtgaaaaatagataatatcaaacacttaacctggggccaggcaaacagaatgcacttaagagagtttagtctctttggttgttgtggctgcttttgattgatggaatccaggagattcacaatgttctgccctcagttgggatggatctgtctgcttcgctctatgactgaggcaggatccttccttaattgatctagttgtggtgtgttgtgctttctccacatctaccttcatcactgtgtcccacagctatcatgataaagtgtggtgatgatctgggaaagtatttagaatggagggaagtgtagaatccggggaccagctaaggacactggaagcttatgcaaaatggactggccaaagaaccaaaaaggcagatgtctttgttaccacctgttctggagtcatggtgggaatgtgggttggtccaggagaccacagtacacagtcatccttattgggttggaagcagctagcttaatgtgcctgtaaagaatctagctcacagtcagagactgatatttgcctctagaaaatatctgaggagcctggggtgtaactcagaggtagagcactttcttagcatacataagaactagggttcaatctccagcactttaaaagcatctgggaaactggatctggctcctctggtaagtgacatagacactgaagaggaatttgaattggcatcagtgtaagtggctcttcctagggacagagaagtgatcttgcattgactgcagagccttgaagatgtgggctgtctaatgaatgcttgccttggcactgttgtccagagaatgagaatttcctgagcctggttcttttttctcccatgatccttcctgtgcttgccttagaggccaagtcttgactgtccaccactcatttctgtagtctaagggaaagcgaaggctgattcagagagatcttaaaggagcaccaatctgtcttggggacacattttctgtacttctcacagtacctggagtgacatcttcaccctaaacaaagtacaccccacagtctgactttcagatgaaccatagtgccgtccatataggctcttcttgtatttgccactcacacttataaacagctgtgtgtctattgccatgttcattaacatcataactaagattgccaccaagagccactattaaacaaacatgatccacgatgcatttaaaaaaaggaaaaagattaaagatgcaatctaaatagaaaatttaaaggaagtaaccaagtcattgggtgtgtggtgtgtgtgtgtgtgtgtgtgtgtgtgtgtgtgtgtgtgtgtgtgtgtgtgtgaatattcatgtgtgcagacacatgtgcacatgtatgttgtggaggtcattatacaatctcagatgtcattcctcatgtgccatccactttgtttttgagttagggcctcttattggcctggattctaccataccatgtagtataggctcgctggccagaatgcgccaggggtccacctgttttcacttccccagcactggaattctgggattataggcatgtgttgctctatctgtttattgttgctgttggttggtttttaaatgtggtttctgaggtttgaattcaggtccttacattttgctgactgagcaatttctccagcttcttgtgattaagttcctttcttgttgattaattttttatttatgtgtttgtgtgtgtgtgtgtgtgtgtgcctgttactgcatgtgtgtgtatgggtgccctcaaaggccagaagaaggtgttgaacctcctggggctggggttacgggtggttgtgagacacctgatacaggtactgagaactaaagtccaatcttctttaaaagcaacaagtgctcatgaccatgagctagctctctagcccctctaccaaacattaatagatgttttcttactggagccttgtcaccctggcagagggtcatttggttgttgagtgannnnnnnnnnnnnnnnnnnnnnnnnnnnnnnnnnnnnnnnnnnnnnnnnnnnnnnnnaagggctctagctgggagagcagccttgtctgccccgttatttcttttccttatcaagccccccacaccacccccagcactcccatcccacacctgagccaattctgttccactgtggcctgagacagagatgctctttgtactgggagtctgactgccttggaacttacacagtggaaaattccttctactgctagatagcacttgagatccagcatccattctctctctgtgtggagcaccaactgaaggagaggagctggggctggcctgggacggtggcatgggagccttcctgtatttttagtttccatcatttcacactgaggcggagactgaaaagcaaatgcatttgtaggctcgtactaagtatgatgacatctttggtttgcagctcctgccacaaagccttgtaagttgtcacctgtactgtaagtttcttgtcagttgagttaagatcacacccaaagtagagaacaaagtttaaaatgatattctaggtcacaaaggtcctttctcagttaaggtccaataagatagcatgtgtgtgcatgggtgtttgtgtggtatgtgtgtgtgagcacacaatcgctgcagcactgtgaggtcaaaggacaactttgagggctagctcttccccttcgaccctgatgtggttctggagattaacttgggtcacgaggcttgtgtggcaagtgcctttagctgcagagccacgtcgctgtcctggaataatctttttagacactttcttactaacatactcaatgattcccctctgggttttttctgtttttctgtacacaatacacccagcatattcaacaacaggtgtatttctggtggcctctgtctatagggagacaattattcccttgataaccacagaccacaggatttagtcatagaacatagagcaatatagaggacactgccaccttatatgtgtttttccctatctctgttggtcttctcatttgtttaaactaggaggtaggaccatgagtttcacagtccttttcaacatcaccatgccctgggtatctgtgacaagcacaaagaggctgtgtgctatggaacaaaacaataaaagaagaaaacaatgtggaaatgtccttggattcctattctccccagcctaccaaagaaagtcccataatgactgatccaattccccctcctcccacttccttatgagaaggagcctgctctttagggaagacaggtaacatgctgagagcagatggagatgaagaaggaaagaaaaccacacaggttgggcatggggagagagactttctgtagttcacagagggtgaaagacagacattaaagcatcagaggggagaagatgaagtgggggcagacaaaagaaagtaccgtgtagattgtgcacttgaattcccttcatggctcagaaataacaggattgattattgagaaatttttaaattttcgtttagaaataatagtattttacatatcaatcccagttccctctccttcccatcctcccatgcccctcactgaccctccatcacaccccccatccaatccccaaggagggtgaggcattccataggggggtcttcaaagtctgtcacatcatttgggggagggcctaggccctcctctgtgtatccctccttggggaatgggctcccaaagtccatctgtgcactagggataaacactggctttgatgtcagaggtcccatagtctgccaaggcctcctaactggcacccacattcagagggtttggttcagttcattgctggttcctcagctttatgactgggttctctgtttatgacttggtcaggtctgctgtttctgtgagtttctctagtatggtcttgacccctttgctcatcactcctccctctctacaactggattccaagagtatagctcagtgcttagctgtgggtgtctgcttctgcttccatcagcttttggatgaaggctctaggatggcattcaaggtagttatcaatctcattattggggaagggcatttaagatagcttctccatgattgcttagattgttagctggggtcaaccttgtagatctctggacatttccctagtgccagttctctctttatacctataatggctccttctattaaggtatctcttttcttgctctcttctattcttcgcgtgactcagtcttcctgatcccctcatgttctcctccccactcctcttccccttgccccccccatgcttccaatttgctcaggagctctcgtcccttcgtccctttctccttctccaggggaccatgtatgtctctcttagggtccttcttgttttctagcttttctggaggtatggattgtaggttggtagtcctttgctctatgtctaatatccatatatgagtgagtacatgccatgcttgtctttctgtgacatgttacctcactcaggatgctggtaggagtgcaaacttgtacagtcactttggaaatcagtatgtcggcttctcagaaaaatgggaatcagtctacctcaagatccagcaattccactcttgggcatgtacccaaaggatgcacattcatagaacaaggacatctgttcaattatgttcatagcagcattgtttgtaatagctagaacctagaagcaacctagatgcccctcaaccaaagaatggatggagaaaatgtggtacatttatacaatggagtattattcagcagaaaaaaaccaaaacaatgaaatcttgaaatttgcaggcaaatggatggaactggaagaaaccatcctgattattgagaaattcaaggaatttaattatgcatcctagagggggcaaaaatcagaaaccaaactacatgcacctctgaatttaggatttgggtaatacatatcttacatagccaggaaaagccacctgataaggggctatttttagctgatacaggaaggtatcaagagatgggacatgactgacatgtatgtcactagaggcaggtctttgaagattgtacccacctctggtctctgcctagctctacttgctgtgtgccactgtgtgaacagttttggcacatgctttgactgcctcagattgagacattctctctgtcctgccttctctgccatgatcaactaaattgctcagaaactatgaactgaagtgaacttttctttccttaagggatttctgtcaggtaatttggtcaatcctgcattgcaagtggcctatcgagggtggttaactgccatggggtcccagtcacccaagcttgggcagactgggttctgactcacagaatgggatactactggtcatggcctgcatgccaaaccttggttcactttgttttgaaacattcacaatgtgcatatctggttatttctaggtgcatccttttgcctcaaagctagagtcagtgcatggtcactatagtggattaataaacatagaaatacaataaaggataataagatggctcagggggaaaatgtttaccacactaacctgacagcctgagtcaattccttgaagccactgtgcaaggagagaaccaacttctgcaagttgttctctgatctctacccatgcatgtggcatatgctcacacacacacacacacacacacacacaccaccaccaccaccaccaccaccaccaccaccaccaccacaacaacaacaacaacaacaagaaaataaaaaaaattaaagttaaaacagtaatacagagaaagggagaaacaactactcaggttccatctagggaaatcagacatgagcttttccttgtcaccttggtttctacatagcatcacttgcttcacacatgacaccactgctcaacacttctacttacagttataagaagcacttgcccatcttaccatggcatgtttacctactgcacaacatcccactgttcctcttccattggagaagaagacaacatacaaagaaaatgattgatatcatgtacacagactactgaggcgagaacagaaaacatgtgatagcaaggcgccctcagagatggggagagatacagctcagctcatcttttctcattctgtgccaacctgatgaggcacatggcttcagcctctgggtctggagagttctacaacacttatgcactctgtttgtgtccttgttgggagaatttacatgaatgaattgtgcacttttgttgaagatgtttattacaacattgaacttccctggaccaaactcaacataatattcttgtttgggaagatgtgtacatcataaactcttgcctcaaaattacatatccataccttattaatagcctgctctgaggaaatggaggtgggcctcttaaatactttttctttctttgtcagatggtaccaagttaggttttgcttgcaaagagtgcttgagagatatttccagaggaaagtagttggctttctagcctagccacaggctccttactgtactgtcttctttagtaccttggatcttgctatgcctgaagcaccctgtagctagtggcttactctgtcgccttttgggtgaactagttactcgagtaactcattgcagtgggtgagacccagccccaacatgctgtgacactgaagagaatggttatcagatccaagagtacactgtgtgccatttactggggtcttcctgacagaagcatgctcagagaagaagcccatgaagtgccttgctaccatccaacatgttattaagaaaagttcattgtgaaatagaagcaggaccagtccacagtctccatcagcaggacagggcttagacaaggacagaagtaacttcatcagagctagaagagacccactttacctcagctgctgccaaagacaccaggcgagcttcttgctatgatggctccgggtctggttgtaagactccacataccactctaatgattttgtctttccaaagagaacagagtagtcttccttaggggcagtcatgtccattatcactcagcatggatgtgtttaagtgagactggatcctcacagttattttgcctccggtgagctatctcccagggaatgctcctagacaccttaaagagtaaatttctatcaaattccagatagcaggttttcaaaagtttggtcagcttgacaatgcaggcatttttcctgcccactcactgaacctcaacagtgacctttttttgagggtcttccagccctgtgctgaagagaggctagacatccttcttgggcattatgtcatggccctcgggtggcagttcaagctgataaccttcagagctcccttcacattctagaggcaattctataatgggctattgtcatctttcttgagtcttatttcctttcttattctcagattagtgttctcacccacgtttctataaccttacatgcttgtttgagttgatcccagaagacacaaactagtcagagtgtcctgtactgaagatgagagaatgtcatcatgaggagctcatcacttccaagtgccaccaaaacagcagactgcctgactctggtcctgggaaacaccagtgtcttcatgtgacccttcacataagcttcagataattttcctccacttcttcaaggacatggattgtggtactcagacataataatggctgcttcttcccagactgctagcatcctcaataaagcccacttcctccttaaaacttatctcttagatactgattttcccatgtggacagcttctgagcctgagtctaggacagttcattaccccactaaccagtagtaattcattctttttgtaaaaaaaaaaaaagacatattcattgttgttttgtgttcatgaatgttttgcctatgtgtatatatgtgtaacatatgggtgcagtgtccatggaggccagaagatggcaaaggatcctctggaactggagttattggcagttgtgaaccagcacagagatgctgggaaccaaacttatgtcctctgcaatagcaacaaatgctgttaatctctgagcctaatttgtaaaacctttgtgtggtggtttaaatgagaatgccatcataggctcatatatttgaatgattggcctctagttggtggaactatttgggaaggattaggaggtgtggtcttgttggaagaggtgtatcactgggggtgggctttgagttttcaaaagcctataccagacccagttcctactgccccttcctctcccacacctccaatttgaagataagctgtgcactctcagctcctgctccagcaccatgcccacctggctattgccatgctccccactatgatggctgtggactcacctctggactgtaaacccccaaccaaaggcttacttttataagttttcttggtcatggtgtctcttcctagcaataggacagtaagacaatggtgagagttactagaaagcatctacctggcacatgctaagtatttggttcacatttctatcattataattcagcctgggtggatctgatgataactctctctggaggaccacagtgcagatgcagtacccagcaaagtacatgcacaactcacctgctccctcacagttttccaggttttagttgcttttaacatcttaccaaataagcagtggcatgaaggacgtttttgtgtacaaagtccacttaatatggggattatttaaagggaaacatagcaatccctcttttccatcccttcttcctcaaatccttacccagaggggagggggagctcacacttgggaagcaagaccaggctagtgctctgccactgaaccacactctgaggcttagagttactcactgtcccttagagaagtgcttcagccatggaacttggttttgatctgaaccaataaggcaaatgaaggattagaatggttcatgttgataatttcagggaaccccagatttttatcagcttcttcctcttcttcttcttcttcttcttcttcttcttcttcttcttcttcttcttcttcttcttcttcttcttcttcttcttcttttggttttttcgagacagggtttctctgtgtagctttggagcctgtcctggaacttgctctgtagaccaggctggccttgaactcacagagatcctcctgcctctgcctcctgagtgctgggattaaaggcgtgcgccaccaacgcccggctttatcctggctttatcagcttcttaaacatactttttaaaaggatatttagggtgggcttcaaggggaggcagttgttctgtagctgcatgaaagctcttccaggcacagaggagcataagtataaaggcccctttaacaggagcctagcagtcatatttgaagagtaataaagacagtgtagctgaagtagagtaagaggaaaaatggtaagtgaagaagacatgaaacaccaagtctttagctcaagtctttagacttttggttattctcagagagttgtgttttagtctgagaatacactggagaatccaggagggttttgagtagagggtgtgtctggtcttggatttttatcagggtccctctggcttttgagtaaggataaactcatgagaatagatggcattattgtgtctcttcccattcctctctctgtgaagataataacatgtcccctaaaaacaccggaaggtgatttggaaacccttgtagaggcatgggccagaatgaaaggtataggttggtgggccagaagccaagaatacttcagaagaggcagccagtatggggaaagttgattctgttgagaaaaattaacaaatagattgcatgcataagtaaaagtcatgaagataacagaaaccaggcttctcattgctagagatggagcttataaacacagaaggggggggtgggaccaaaggaggtaggaggatgaagtcatgggtatgtatttatgtatgtatgtatgatctatccatctatctatcatctgttatctgtcaccttttaaaattttgaatgtatgagtatatgtatctatgtactatacacacacacacacacacacacacaaacatatacatacatacatacacacatatatcttagttctgtctactgagaggctttagaagtagtgacatcctcttaatactcagacacttctttctaagtactatcctaactgaaagaaacaagggttcaatgaagaaggaacttggaaagtgcaaagtgacccgaaaccttatgctgggaaacagaaaaatacctagtggacattgggaacattttagaaggctacagatcttctcactggccataccaggggctacttttgctttcaaacattactggtatgttgtgattcactgaacaaagtgggaatctatgaggcaatgttgatatagttgaatgagtgcatgagcaaggggaagggaatggcgtataaaattaaaatcttgtttattaatgtgtgtgtgtgtatgtgtgtgtgtgtgtgtgtgtgtgtgtgtgtgtgtgtagtgttttacctgcatgtatgtctatgcactgtgtgtgattaatgtccatcaggtcagaagagggcataggatcccttggaaccatagttatagatgtgagccattatatgggtactaggaatcaaacctggatcctttggaagagcagccagtgctcttaaccactgagacatcctccagccactaggattgacttgtgtatcatagaaaatcaactagtaaatgtagatgaactaatgaaaataaagaattcaataaccatttgtcagtctctgcaggcatggctaactttggctaaaattgttaatgggagttaggctgatgggtcatatttcatgaggaatagaggttttcttttacatactctagggagaactgaatttcagtgagaaacctggctgagcttgtgtccaggtggccaagatggaacagggtggtcttgcccattttctgctgagatgtcctggaacataccaccattgttcccatggaatatttgccgtggatacctattcctgtgtctgcttaggaggagacacccatttgccatgaatgtatttcttgtgtcttcttaggaggagacacccagaattctaagcaaaggggcagtcaccccacaaagtgtagtacttctggggactgtcaagtacatgaggagctatttcagatagaagagatgcaatgttacatgtgttcctcagaaaatcctgagccacagacaaaacagacacattttggggattagtgaaatttgaataggatggtgatatgtcaatactgatttcatgatttaaagactgtgttctggtttatatatgtgttttgaaaagtggatactggattctggaagatgataggacttacaatgtttagaacacatggttaaaattatttcaaaatacttttagttttaaaagaagtctattagttgtgaaagatggtgatgattttggctagagaggtgacatggcagtggtaggaaatgatcagtttctggatatattttggaagtagactcaggtggaaattcttgatgaattggatatggatacaaagtagaattagttgcagtcatgagtcttaggttttggttctgagcacctaggatgaagggccatcttatcaattattatatgaactgtgactggggcaggcttgtgggaaaatagagtttctttggtgaattgagttggagatatttattagacctttcaacgaagaccttaggtctttaactaccagaatgggaagcagaggaaggcagcagggctgcagagtcacatgtgggagctgtcagcaaacagagggctttaagttgtgaaggtgagctctctgagagaggggagtggattcaacagaacagactgcttttaggacttcgaaactgaaagttcctccaccaaatcacccaaaatatatctaactctgtaaaagtccatgactaatctcccaatgttgtttgtccccaacgtgctaaaagttagacctatgaaaagagggttaatataaaaatgctaacactctaacattgcataaatgtgttcgtagcgtgtgtgtgtgtgtgtgtgtgtgtgtgtgtgtgtgtgtgtgtgtgtgtgtcaggcatgagtagcttacatggattgccttgggcatcttcaattcaacctcaggagggaagaaatagaatttctatttttcatgtgaggaagctgaggcttggggttaagaaaatttgttccaggtctgagagctggtaaatgatgagactgaagttcattctcgtatgatctacccatgctgacttccagctccatggctgcactgtcctgccttcaggactggagaaaaactaaatggagtttgtatggtattctagagccctcttgactggttaaaacagcacaacacatttccccacagacacctccctgctaccaccaaacaaatatgtatctgaagatttaagagaattgcagaaaatttaattccctaaactagctgttccttactttctggggtgccacccctctgaaagaagtcatagaaactttggtggttgttaaaagaaacaaacaaataaacaaaaaccatggatatccaaccctatggatatctcccatggtgtgtgtgtgtgtgtgtgtgtatgtgctcgtgcgaaggcacatgaatgttcgtgcgcatgactctaggcaccatggtgtacatgtagaagtcagagcatggccttggggtatcggttcttactttctttttttttttttttttggtttttcgagacatggtttctctgtggagcctatcctggcatttcctctggagaccaggctggccttgaactcacagagatctgcctgcctctgcctcctgagtgctgagattaaaggcatgcaccactaacgcccagcccggttcttattttctgtcttgcttgaggcagaacctgttgatggccatctcataggctatctggcctatgagcttccagggttcaggggaggggagtgactccatgagataattctgtctcctcctgtcatcttgcctgggaacacctgttatagatgcacactacctggctttcttgtgagactgaggacttgaacccaggaccttattttttcctggcaagcacttttcccattgagccatctcccagccctgaaaccctgtgtttttaggagctccatctttcctgaaatgtctttcttttggcttgctgttgtctgccacttttataagctactgaaccacatcgctggtgtgaacagtttcatagcttacatatttcttcttgtaatcagtttagtcgatcttgtaactataaagagtgagatggtaaatccccagctcccattctgagtcagaatttatgacaagaacaacgtgcttgtgcccaaacagaaccatgcatgtatggtaatacggcactcgaaatttatatacttccttttatccaaggaacagaaagtgtctctataaaatggattaagagccaactgtctacagcaggcagtaggaacagttcaaaatagtaatgctgaaggaatcatttaatttccaccaggccagggttcatgctatgcgaccatggacccaacatggttactggagaccactgacattttcacctccactcaacagttatgcacctaactgcaacttgtgtaattgaagattttcctttcttattgctgtttgctactgaataccatgaaagatcaggccatggcatcagtaagcagattggtaacagaatcatcccagccattcatatgctctgactcacaggtgggcttttcttcttactaagggcaactctttatagagaattttctttgccagtattaatgactccagcctcaggctgaggagatgactctgtcagtaaatcattctgggcaagcatgcggcttggaattaggtctcatgtggaacagctgggtgtagctgttggtggaatgtctccttcagtcctaggccatgtaagcatctcacaggcaggagggcaaaagagaggtccaagaagacagaggccatggtctcctgaagtttaatcacaggagtgatattccaacaccattgtgttgttttgctagttggaagcatgccagtgctttatacaaaatggcaggggactccatagggcatgcaagtcagcaggtgagactcactgggaaccatctgaattctccctataccttagctggctgtatcctgttaacaaccctctgggcagccttatcatttttactttataggtagaccaacaagagctctcattcttacatctactgacattgagtgatttgtagagttcattcatcagatatgtgattccaagccattaggtatgctacaagctttatttgtttatttatttgggggaaagtgtctcactatgttgcctagtctgtcctcaaactcatgattttcctgcctcagtctccctaatgctgggattacaggtgtgagacaccatgcttagttgcaagtttttaacttggtagactatgagtgtatgtatgcaaacatcctagcacttctccttctccttctccttctccttctccttctccttctccttctccttctccttctccttctccttctccttctccttctccttctccttctccttcctctccctctcccctcctccttctccctctccctctccctctccctctccttctccccctcctcctcctcttcctcctcctgctcctcctcctcctcctcatcatcatccttcttctatttttcaagacagggtttctctgtgtaactgtcctggctgtcctggaagtagctctgtgagacaaggctgtcctcagcctcacagagatccacctgcccctggctcccaagtgctgggattaaagacatgtgccaccactgcctggctttgtgctggctagtttatgtcagtttgacagaagatatctgagaggaaggaacctcaattgagaaaaatacttccaaatgatcaggttgtaggagagcctgtagggtattttcttaattagtgattgatgggagaaggctcagcccattgtggatggtgccatccttgggctggtagtcctggttatataagaaagcaggctgagcaagccaaagggatcaggccagtaatccctttgcatcagatcctacctccaggtcctttcctggtttgagtgcctgtcttgacttccctagctacgtggaaatataaaccaataaatcttttcctccccaagttatttttggtcatggtatttatcacaacaatagtaaccctaaccaggacataaatcttttatattattatatgcattaagaattttcaaaaaataattaattgttctatttttatttccaatgctatacctggagacactctggatttttaaaagtagataatttatgaatactttgagaattttgtgtcaacctcatgtcttcttctttttaaaagatttagtaagcccttgactccagtttgtggtgtccatacatttccagattttaagagtctaggatctaataatttctgcttcagagatgaagaacactggttaagaatgtttgtgatgtaaagaacaggctaggaactgaaacagaagatttcattgtagtccaacttatagcttaatctttatgtacaggtcataccaaaaagttgatttgcagtttgaggaaggtccacatgaaaagcacatcaggtccctgacacaggcttgtgttcccactgctctaaagatcatgggcaagatttacaaagacacccacatttggtcaagttggatgagcccaatccaccttatccacttgcagacagaactaaactaacaggcttgttctttttcttttttaaaatttatttatttattttacatcccaactccagttccctttcttcctctcctcccagttccctgctacctgccctctgcctccccctccccccatccactcctcttccgttttattcagaaaagggcaggcctctggtggatatcaacaaaacatagcatatatcacgtggcagtgagactagacactttctcttgttttacgtctgggaaagggaacccagtgtgaggaataggactctaaaatccagtaaaagagtttgagacatcccctcttcccactgttaggagtccctccagaagaataagatacacagttgttacatatatgtagagggccttggtcagagccattcaggctccctggttgtcactcaagtctctgtgagctcctatgagcccagattagttgtttctgtgggttttcttgtgatgtccgtgatcctattgactcctacaatccttcttcccccttttggcaggattccctgagctctgcctaatgattggctgtggatgtctgcatctgtttccatcagttgctggatgaagcctctctgatgacaattggtctaggcaccaatctcagcacatcccatagactcgaaggttatgttgcttggttgatgtctcagttcctccactgggagtcttgcctggtaacaggggatggctaattcagactgtgtatccccttttgctaggagtcttagctagggtcatccttatagattcctgggagtttgccttgcccagatttctacctgaccctgaaatgaccccatttccagatgtgtcttccagcactctccccacataggcccacctgatcactcatgttcctttctccactagaccccagtccgttcatgaaatctcttctatttccccttccaagggagaacctaatgattccacttaaggcttcacaccccttgctacctagcctctctgggtctgtgaattgtagcttggttatccctaactgtacagctaatatccacttatgagtgattacatattatgtttatctttctgggtctgggttacctcattcaggaagattttcttccaagttccatccatttgtcttcaaatttcatgatgtcattgtttttaacagctgagatcaacaattaataaatggaatctcatgaaactgaaaagcttctgtaaggcaaaggacattgtcaatgggacaaaatggcagcctacatcatgggaaaagatcttcaccaacctcacatcttacagaagaccgatctccaaaatatataaagaactcaagaaactagacatcagcaaaccaaataatccaattaaaaattgggaacagcactgaacatagaattctcaacagaggaatctcaagtggccgagaaacccttaaagaaatgttcaacatccttagacatcagggaaatgcaattcaaaacaactcagaaattccatcttacaccagttggcatggctaaacacaaggaacaatattcaacaaatggtgctggtataactgactgtcaacatgtagtagaatgcagatagatccatatttattgccatacacaaaactcaagtccaaatggatcaaagacctcaatgtaaatccacccacactgaacctcatataagagaaagtaggaaataacgttgaatgcataggcacaggagaccacttcctaaatggaacaccagtagcacagacactgagatcaacaatttataaatgggtcctcctgaacctgagaagcttctgtaaagcaaagaacatggtcaacaagacaaaatggctccctgcagaatgggaaaagatcttcaccaaccccacatctgacagagggctgatcttcaaaatatacaaagaactcaagaaactagaaatcaaactaccaataaaccaattaaaaatggggtacagatataaacagagagtactcaacaggataatctcaaatggcagaaagatacttaagaaaatgctcagcatccttagtcatcaaggaaatgcaaatcaaaaccaccctgagattccatcttatgccaatcagaatggctaagataaaaaacactggtgacaactaatgctagagaggatgtggagaaaggggaacactcctccattgctggtgggagtgcaaacttgtaaagaagctgtggaaatcagtatggtgatttctcagaaaattagggatcaacctactgcaaggccctgcaataccactgttggcttatacccaaaggaggcatattcacaccacaaggacatttgcctaactatgttcttagcaacattatttgtaatagccagatcttggaaacaacctagatgcccctcaactgaagaatggataaagaaaatgtggaaacagatgcagaaatctagaattaaccaatgggccaagctcctggagtacatttgaagtgagggaggagtgataatatgaacaaaggagtcaagaccatgatacagaaacctacagaatcaactgacccaagccagtgagagatcactgacttgggtctgacaaacagggaacctgcataacactgaagtagactcccttaatatagatgataatgatgttactgggacaatatatgaggccactagcagtggatccaagatctaactctaatgtacaaactgatttagtggagcccactctatatggagagataccttgcccagcctagacacaagggtgtggaggggtggagaggtgccttggtcctgcctcaacaacatgataggacagacttagtagacttcttaggggaggccttaccctcccctaggagcagatgggaggtgggggtagggagcaggagaagaggagggggtaactgggattggaatgtaaaaaaataaattaaaaaatctttatcaccccaaaaaataccccacaagggacagctcatgctggagaggatgtggaacaagggaaacactcctccactgctggtgtgaatgcaaacttatacagctactttggaaatccatatggcagttcctcagaaaatagggaatttatctaattcccaatttatctaagtcccaagacccagctatagacccaaaggatgctccatcctaccacaaggacaatttctcaactatgttcatagcagcattatttgtaatagccagaacctggaaacaacctgactatccctcaactaaaagatggataaggaaaatgtgatacatttacacaggcttgttcttaagagtcagccctccatatccactgcttctacctctctctctctctctctctctctctctctctctctctctctgtgtgtgtgtgtgtgtgtgcacacacacgtgtgcatgtgcacatgtgtgtatgcacgtgtgcatgtctgtctgagattggacataggcttttgcttatgtgctgcaccatggagttgcactccaaccctgctttgagataacaggagatatcctgagatttgaaactcagggaggaagtcttgtgtgaatgtctctttagttttttgtttttcatttgtatgtgtctgatatacatgcttgtgtatatgaatgttcacgtctgtgccagagtccagccttgcttgggttcaggtccttatatggggaaggggtgtcggaaattctgaccaccaggtggattgcactcaagtggccctgagtagcccaaaccatctttatttatacttcaacagagttccccccaccagaggggggaacttacatgaggcttacatgagcaactttattattggctcctatttttacttctaagaaatacatcatattttaagaaatatattgtaatcattagaaaagtccccattgctcccctgtatgcttccccaaatatgttttcccaccctctacatagccttattctagacatgagttcagcgtttttgcagggttaactaaatgttgagccagacacatcctgctcttgcagcacttatgtcagctggcagctacctgcagttacaaagttgaaagtaatagacatgggtacagtgctttaaggacaacaatattcaaacccaaccaattctttcatgtctgcaagatatgcttttatacagtgtccttttctacatgacagtcccatatctcaatctctctataaatggcagactttgataaggcactattttcccatcccactataccacacttcttccatcagcacaagtgccatgtatgtaaagatagatttatctgtcctacattttacattgaggttttcccccattggatcatactagaacttatccctgattctatatgagagtaagtaagggaacttactctcaacggttgtcactatacatattcctgcagtttttccctctattctgtgtatgcatgccttactctcctttccagaactgtgagacatggttaatgctccaagtgttgttttctcatatgtacctaactgtctgtattgagtcagaaaagctcccaggactaggggttgtagttaataattccagattagaagtttgagaagcattagccctctgctgattctaaggggaaaatatttgagaaagaacagaatttccagggaaaattacagctgctgcatgtgtgactgacaaagtaaaactaaaaaaccgcccaaagaatgagtgaaatatgagagaaaaaaaagaacctgaaaactgcatgaattcagcaaagtcctgtgatgcctcatgggtcattgcttcttgccaagtgagataccgtcttccttggagaccggttggggttggacggacgttcatatgctggtccaagactaggctgcatggctcccgacacatcagggtgtttgtgaatgtaagtttcaaaagctggtatcagccgtcttcctgtccctcccactttgctgaagtaggtttcttgataggcccagagcttatcaacactgcctggtgtaactcactaccttgctcaggtaccctgtctttgtctcctgagtgctaggattaaaggtggccattatgtctgtctagcttttatgtggcttctggggacccaagctctatggtcctcacgaatgcacagtgaacagtttgtcagcaagtcactgtctcagtccctaaatcaagtgtttcctcactagcagaaaggcttcccacttatctcctgggatggatacatctctggtctatgaatttcctgaggccaaaaggaaagacaggcctggcttaataaaagccctagcagggtctgcagaatcagtgagtgcccactgatgcctattgggtaacttggagaaaagctactccaattggaagaccttttgcagacagttatttttggacaacaatctcagatatgtcaacgtagaaacagaaataactggaggcaggagccatggctttctgccttgaagtcgcatgtgtgctgtggttgatttcagctttttgtgacatggtcaaaagatctctagaatttaatgcctctcttcccacaatctgtctcccctggggttgggggaactgggccaaaatattctatagagccagtgctccaagaagcagcttctatagcaacagagcaggtaggaagcagctgctgtggtttctatccaatttttcttccaaataatccagatttctaagagataagaaaacacaaatacaaaaatctcactagaattctggattagcaacagcattccgaatcatctctgttttgatacactggctgataattgggctatagctgggtctaaaaataacacgcagtatattaaaataatattcctaggctacatttccaaagtggtattcggggacttctgtgcattaatcctgtaacaataacaggatttgtgctttcacctcccctggtgtagctttgaaaatttagcccaaagcagctagtattgccgtttaaatcgtcctttcacatccgcagggaaatgctgagataaaaaaaagaatcgacagcccgacagctcaaatgacctatacctgtgagaatcagagaaacaacctatttcctctcaggaactgggccgatcaatataaatatttcaaaaggaccatcatgcaataaaagccttggaatctgtatcgtactttggaacaccctagatatttcccatgtggacacatccagttttccactgggggagggagatgcgatggttgaatgactggaactgtgctgggctgctcaagtgttcgtgtttgtgtgtgtacatgcatatatatgtgtgtgtttgtgtgtatgtgggtgtgtatatatgttaatgaggatgtgattctgtgtgtgcctgtgtgtatctatacatgtttgtgaccctctgtgtttatgtgtgcatgtgtgtgggtgtatgtgtatatatatatgcatgatgtgtgtatatgaaagagagagagaaagagaggagtatgtgtgtgtgtgcatgtattcaaatatgtatgtgaacctgtgtgtgtgtgtatgcttggagatatatatatatacacatatatatatatgtgtgtgtgtgtgtgtgtgtgtgtgtgtgtgtgtgtgtgtgcgtgtatatgtaaacatctctgtgtgtgcctctgcatgtgtgtgtgtccttttctacatgacagtcccatatctcaatctctctataaatggcagactttgataaggcactattttcccatcccactataccacacttcttccatcagcacaagtgccatgtatgtaaagatagatttatctgtcctacattttacattgaggttttcccccattggatcatactagaacttatccctgattctatatgagagtaagtaagggaacttactctcaacggttgtcactatacatattcctgcagtttttccctctattctgtgtatgcatgccttactctcctttccagaactgtgagacatggttaatgctccaagtgttgttttctcatatgtacctaactgtctgtattgagtcagaaaagctcccaggactaggggttgtagttaataattccagattagaagtttgagaagcattagccctctgctgattctaaggggaaaatatttgagaaagaacagaatttccagggaaaattacagctgctgcatgtgtgactgacaaagtaaaactaaaaaaccgcccaaagaatgagtgaaatatgagagaaaaaaaagaacctgaaaactgcatgaattcagcaaagtcctgtgatgcctcatgggtcattgcttcttgccaagtgagataccgtcttccttggagaccggttggggttggacggacgttcatatgctggtccaagactaggctgcatggctcccgacacatcagggtgtttgtgaatgtaagtttcaaaagctggtatcagccgtcttcctgtccctcccactttgctgaagtaggtttcttgataggcccagagcttatcaacactgcctggtgtaactcactaccttgctcaggtaccctgtctttgtctcctgagtgctaggattaaaggtggccattatgtctgtctagcttttatgtggcttctggggacccaagctctatggtcctcacgaatgcacagtgaacagtttgtcagcaagtcactgtctcagtccctaaatcaagtgtttcctcactagcagaaaggcttcccacttatctcctgggatggatacatctctggtctatgaatttcctgaggccaaaaggaaagacaggcctggcttaataaaagccctagcagggtctgcagaatcagtgagtgcccactgatgcctattgggtaacttggagaaaagctactccaattggaagaccttttgcagacagttatttttggacaacaatctcagatatgtcaacgtagaaacagaaataactggaggcaggagccatggctttctgccttgaagtcgcatgtgtgctgtggttgatttcagctttttgtgacatggtcaaaagatctctagaatttaatgcctctcttcccacaatctgtctcccctggggttgggggaactgggccaaaatattctatagagccagtgctccaagaagcagcttctatagcaacagagcaggtaggaagcagctgctgtggtttctatccaatttttcttccaaataatccagatttctaagagataagaaaacacaaatacaaaaatctcactagaattctggattagcaacagcattccgaatcatctctgttttgatacactggctgataattgggctatagctgggtctaaaaataacacgcagtatattaaaataatattcctaggctacatttccaaagtggtattcggggacttctgtgcattaatcctgtaacaataacaggatttgtgctttcacctcccctggtgtagctttgaaaatttagcccaaagcagctagtattgccgtttaaatcgtcctttcacatccgcagggaaatgctgagataaaaaaaagaatcgacagcccgacagctcaaatgacctatacctgtgagaatcagagaaacaacctatttcctctcaggaactgggccgatcaatataaatatttcaaaaggaccatcatgcaataaaagccttggaatctgtatcgtactttggaacaccctagatatttcccatgtggacacatccagttttccactgggggagggagatgcgatggttgaatgactggaactgtgctgggctgctcaagtgttcgtgtttgtgtgtgtacatgctcctccactgggagtcttgcctggtaacaggggatggctaattcagactgtgtatccccttttgctaggagtcttagctagggtcatccttatagattcctgggagtttgccttgcccagatttctacctgaccctgaaatgaccccatttccagatgtgtcttccagcactctccccacataggcccacctgatcactcatgttcctttctccactagaccccagtccgttcatgaaatctcttctatttccccttccaagggagaacctaatgattccacttaaggcttcacaccccttgctacctagcctctctgggtctgtgaattgtagcttggttatccctaactgtacagctaatatccacttatgagtgattacatattatgtttatctttctgggtctgggttacctcattcaggaagattttcttccaagttccatccatttgtcttcaaatttcatgatgtcattgtttttaacagctgagatcaacaattaataaatggaatctcatgaaactgaaaagcttctgtaaggcaaaggacattgtcaatgggacaaaatggcagcctacatcatgggaaaagatcttcaccaacctcacatcttacagaagaccgatctccaaaatatataaagaactcaagaaactagacatcagcaaaccaaataatccaattaaaaattgggaacagcactgaacatagaattcttgcctagtctgtcctcaaactcatgattttcctgcctcagtctccctaatgctgggattacaggtgtgagacaccatgcttagttgcaagtttttaacttggtagactatgagtgtatgtatgcaaacatcctagcacttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttctccttaaacatctctgtgtgtgcctctgcatgtgtgtgtgtgaaagaatgattattgtttatgctggaacttaggtgcatcccagagactaggtgctgctgatcacgtcacctaagaaactgcatatcctaaaatttgcactcagctctaaattagagctctaaacagctctaaatggaagtgacatgagttttcaatgatgccattaattgctttccactaattgagaagagcttttgtgcagctatggttgtggtggcttagatttaaccattgtagggaccgttcaggctggcactgctgtggcctgccatgcctttgaaattctaaaaaggaaaaggaggccaacatgccaagcaattattttggaacagattgcccggtaacatttcatattatcactgaaatccatcctttctgggacagagtcttgctttggccatgaacatccaagagatggcagcacccctgctctgatggctggttgcgtccctccagacagctcaccgcagaggtcttgtcattgcgtcacctgaaagccagtttggagggtgggggtgggggaggtgtagcattctcagcttggttcttctggagagttccggaaacaggctcatggaatgtttgaaacgcatctgaaaaaggttttcttttttccattgaaatcccctgctgtgtgtcatatctttctaagaagaccacttaggtgttccctggcttcctccatgagggaagaaggaagaccttcagttgccagggatcccctaagcctcatttccaattccttgtgcttgtttttttttttttttttttttttttttttttttataaacacagggaggtggagataatatgacattattaacaattgcgttttgaacatgtatgcattcaaggcacttagctcagcatcgggaatgtggtacagcctccacccaggacagctttcttcttccccaccgactctcttagcagcccctcccccatccccagctaaaaatattctacagaacaaatagctgttgagacagcatcaaaccctgcaagaatgagtgacagtataacctgccatgctaagtgtcaaaagtctgacatgaaaagcatttggtgacatacatgagggagtgtcagggctgtgtagacaggccagcgtctaggtcttgaaacccaccctgcttcgtgtatgctgaacagttggagggcaattgcggggactcactgctgtggcctgctgacaggattttgaacaggattcaggggcaggactatcatgggaaactagcttattggaggccacagaaccaaggagctaggttcagctccaggacttcctgctcccaccttatccatcacaggggcttggcctctgtgactactgttttggctcccacttggcctggcttccactctgttttctcattggctcatttcttcagcctcaccctcacctcaacaatctgtcttctgcccaggagcatggccacatggtttgtgttctctgtagacaccttttcagtgtcaggtctatcacattgttacacaatgacatgtgcttaagatttccagtagattgtaatagcaaggagggagaggaagacagactggcacattccatgtgtctgtatgcagagagctttgaaggacatgccacctgaggaacgctgctgtggtatccccttcagaaagaactgccctccattcaggagagctgttgatgacactgaccgtttactgtgaaagcaccaatgtttgcccaggctcgcaagggtgggcaccctggtcctataccctggtggtctcagccttgaaggggagttgaactctttaatattttctgtttgtctatctatctatctatctatctatctatctatctatctatctatctatctgtgtgtgcctgcttgtctgtatgtgcaccatatatatcaaggtgttctttggaggccaaagaggatgttggatgccctgcaactggagttacaggtggatttaagctgccaggtaggtgctggccctctgcaagagcaacaagtatccttaatcactgagctcccctctgcacagcccagagggttggactcttaatgccatgtttgtaggaattcagttatctgcaattgcccagtcttcaatgactccagacaactgaagaaagatgtatagagtcttcatttaaactgtggtttatgtaactttgcacagcatgggtttgtttgggttgggagaaattagatatcatgtaataaccaaatctttctcagagaagtctcagacttaacactttgtttgagagacagactgaatactactgcttggcgttcatgatgtatatgacaatcaatgcttcagctatcgcccattgtgttggctgcatccctggctggtacagccaagccatctggagcaggggcaaggagttcatgggatacacaggccagaagctgctgtggcttcatggccctgctccaccttgctccaggcctttccctgttacactgagagcctctggcaaagtgaggcaggccccacaggcagagtattagtttttggcttcttttccttgtacccccagagtgggaggtgctctgttctcttcagctacttgtcttgagagcctgaacttcccttccatctcttcatttagagcttgtgtcagccatacccgccaacaggaatatatgggctgtggcatgagcacagattgtagataggtcttcagaggtgacggaagtcactcagtacatgtgcaggaccttctgtggacagtgaatttggttatccattccattgctttgtagcatcacattgatcatagtctaaagttttttatttataacttttattatttggtgtcttctgttggtaagtttgaacttaatagttagattaagttccttgaaagaaattagtttccaccttcttacattttccaaaaggtggtcttccttttgctcatggtttcattcccagtagtttttcagtcagccatgatctgatattaagtggaaagttctagagataaataatttgtatgtttgaaattatatgccagttggagtggcttgttggaatcttgcatcaccccattgcaacctatctggaacaggaatcatctaaggccaagtgacctacaaactccatcaagtagtagttatcacagctatcagattgacttctatagaggagtctgatgagtccactattatttgaactttcaggcatccaatggtgaccttggaatatggctctgtcatttaagtgggtgaccaccatacaaacagcgagcacccagtgaatctcaatttcatgtcagttcaagagaatttctcactaaggatttagagcctttccagtcaggagataaagatttattatgcccagtttgccaatgttgatctcatgcccacttcaggaagactcctttaggcagttcagagtcccagactgcctgtggaatctgaagtgacctggacttttcaacccttgacctcatgctatgtgtcctagtttcttccacaatctactctgtctttgagaagtaaagcttccaaaactcagtagaaagcctacttggctgggtagttttaagacctaagtggtggattttttgccatctcagtttgtgctccaggagtgacacacatcatatctggtatttccttggccaaattaagttaacaggatagaggagtaggatacttggggaactctgggaagaggcgaatcaaatactggagacatgcgtagcatagctacacttccttggaggacttagtagtggctgctaaccagttccttcttgaatgacaaacctttatcctttttggttcacacagactgaaaaccaaaataggcctaaagatgatttatgtcattaaaatggccttattcttttgggtaaatgtcaaggttttccacttaaagtcaccagttgtagtacttcctaaatgccacatgtgatgtgtgtctttctagtgtgtaagtctgctggtgtttctaatgcttgcagaacctcataaagtccatcattatagagcagtgacacttcagatcccagctacgatgtttatttcttgtcctgtgactggcaaaaccttttgtcaccaagcatgaccccaagttccacaaaggcagactgaaaccgtcatatctcctgtagttgtcctgttttccttgcttggaccacaactcccctaaaacatacaagcacagccataggaaccagatgtgtgcagtaggtacatgccagaggtcatcgttaggtgtcttcttctattagactccactttttaggactccactcttactttttaggacagggtctttcactgagttggtagctctcattttggccagcctggctgctctgtgagacccagggatactcccctatcttatgagttcttgggttacaaacacatgctgccctggccagtttttacatgggtgctggagatccaaatcaggtccttatggttgcacagcaagcatgttagccattaagctatcattcaggtccttcgagttcattcttaaacataaggattttggtaagtgaatgaacctctatcctagtggcccattttttttttttttttgacagggtttctctgtgtagctttggagcctatcctggcactcactctggagaccaggctggcctcgaactcacgagatctgcctgcctctgcctccctagtgctgggattaaaggcatgagccaccaatgcccggcccagtggctcatctttatgatgtccagctagcagtcagctgtggttggattgaaaaggccccggctttaagttctgatcaacagttcagtccatctgtgttaccttggaaaagccatcttgcctctccgaactttcactggttaaattaaggtaaccacactcaccctcagaatgaagttttcttttcctgttgataaagtgcagctctcagctgtggggacttgagtgctcttgacaaagacattgtctgggcaagtgtgtgtgtcccaagctgagaacttcttccgtccttttctgcttgctaattaagagtcataaataaaatgctgatgagcttcatcctgccgtctgtgctgtagctagagggctgttttgactttgcctgacaaatggctaaccagccgctcccaccaagcccagctcaactgctcagcactgacaactccagactgccagcagcatcttataaacttgtcactatttgcttactcggtgacagtgtttttgttcggtgagtatctctgagatttcacccatcagggtgtatctgtttccttcaaaatgccaagatgccattccagtgccactgtttctcaaagcacatggaagcagtggtgatctctaagtgagactgggaacctttagcatttgcatgtcatagtcctgctggggtaggatgcagtctttaaaagaagaggtagggcatgcaagggctctgttaaatggtcataaaccttggagttactttataaactactatgtaagactcccaggtgatttgttgagcagtttgctggaggcttatggcaccagctcaggagagtgagctgttgcattttgaattcctttgcaagctgacctgtgtcacgttgatagactgaaatgggccatggcagcaacgttgacactgagaagttggcagacattgcagtgtgtcccctgctcctcccctgtgaattggtgttaactcagccttcagcatctcaccaccatacaatatcaccaagtcttcttgcacctaggtcacacccggatgtaactaagtatggaaaaaaggatgccccaagtcagggctgcaaacataggtgtggcactcggtaggggagccgggccccactgcactgcaccctgctatgcaccagggtccatgcaagcctacacttggactggcacacaacagaagctggtcagcacaattaatgctgtggcctgccagaagggagctcaactcaaagacagagaaccttccaagtttgtctcagctgatgcttatggggggggggatactaggttaaacctgatacagatcatgctgtcctgagtctaggccctagatgagacttcagctaggttggggaagcccccaaatcaaacatggaaaggctgctgcagaaaacctgggtgtgccgctgttgctccctagcctgtcttgtttgatttaggaccttcgtagcggcattttgggatcagtagaggcttagctgacccctagagctcagtgtagtaacccctttgatggtcttataaagagtacattgtagggacctgcaatatgcaaacgcaggggtgtataaggtatttatgaccgctaaggcaagcaagatgggttgcacatacattccacagacagtcctctggaatcttctgaggaaagaattgataggtaaagaaaggaaggctccaaggacttgctgtcacaggtagtaatcagcagatctgaggttcaaacatgtctctgtgtgactgcagaccttcataggctcctatagcctcctgacggtgggttggctagccttacccactagaaaggtctttattcctgtgccccatagccaactctcctgcctaggaatcctgtgcctttctgaattttcacagagcacccctagctctgtgggcatattcagtcttctttcccatggccacattcttctcttggtcatttctcagctggcatgtgtggctgcgtggggccctttgcagtcctcactcagctgctgctacataaataagccccatgcccaaacctgtggtgttgaattttcctgatcatgccactcctctccttcctctcctatagagccacttctggctcttctgtcagcacctacacctggaaacataagcattcctccaagactaacgtggattcacatctcctcttttaacctctctgttctgtggtcctagggccacagcactgtatgaagatgtcctcatatcaacacatctgcaggtctcactgaaggatgactagaagtaacctgatcccatctccaaggccgagcagactctggaatgtggctgtcaacaaagggatttcacaggaagggaactgatccccatcaaggttacatccaggagacctcaactccttcaggtctggagctttgccttttctccacttttggctccttgatttagcacagtgaatagtagctgttcaataaatgatgactgagtgaatgcaacagtcgaagattggtgatgcattggcgtagagctgtggaagtccttaactgggagccagacttgactctgtgtacagtaggcttgcagctgcctgtggcttttcctcatttgagtaattcaactagaggtaagctcgaagatgactcatctgggtgctgtcagtgctcaaggtcctgtgccatcttattccctgtccttgctggtctgtttagaattaacggcccagtctcattcacttcaccccaaaatatatcttcatggctttattctaggtttttacctctattcttgaatccacttgcaagtcagtcctaattactgctcgcctcagtgtcacctctatcatgtcactacacacgccagttgatgtctctcctccctcctcttcccccctcttctctttgcatagatgtgtggtgtgggtatgcatgtttgcatgtgtgtgggtgccctgtgtgtgtgcctgtgagagtcagagttgatgttgggtgtcttcctcgattgctcttcactttaaatatggagccaaggactccttctgaacataaagctcaccattttgactaatttctctacccagcttgctctgggaatttcctttctctatctcccatgggctggagtgcaggtggctgtcatgcccaaaacagcttttacataggctccggggatcctatgtaattcacccctgtacaacaagcacttgatcagttgaaccatgcccccagcccctgctagtcctttttctttgtgccaccattttttggcttttttttacttgtgtctggttctgtgtttgaaacaaaacaaaagcaaaacccaagttgaactggctctgggaaaacatgggagtcatcttatagcaaagcaacactgaggagaaactaagccgccatgggtggcatctgtgcctggctatgttgcttgagacagaagggcagagataacagacaacaatcctttgggagagggagaaaaaggaagaaataacagaagtgatagacgataccttagatggaaggcagaagaaaagagtgagggaagaccaggttggaatctctaccattttgatagctaatattgagtgtcattttctgaaaatattttgtaataatttttgtgagcccataatatatcttcataaagaagggagctaatggactttagaggcttgtttaagttttagaagtttagtttttgcaagtgaagaaattgatggtacattctgaaaacttttttttgtgctcatgtacgtgtgtgttcatgtgtgtatcaatgtgtgttcatgtacgtatagggcagaggagaaccgcagggattacttctcaggtactgtctactttggtttttgacacagggtctctcatcaacctgaaacttgtcaagcaggttgggctggctgccagtcagccctgggcagccgttttatgtgtccgtctccccagggctgggtaatacataccaccacacccatttttatgtgagttctggggtgttgaactcaggtactcttgcctgaagaaaagcactttaccaattgagttatggactttggacacagggagtctaaacggcactgctggggttctagatccaagcattctaagaaaggtgtgatggcccagaggaataagctactactttggaaactcttgtcctaagttacaagttcttaaagacaaatgtgttagatatccagattttatcatcacacacacacacacacactagagcaaccatgggtttgagtgggtgacactgaatttatggattggaaggagtccagtggtgcaggtgactcaatgccagtttggtctggtatgactcagtggtttggggaggatcaagggacatgccccccaaccctgactctgatgaaacagtgtaaaatttcatgggaacatatctttggaaagactccatttctcattccaacacttaacctattgcattcatctaattcaacttaattctgaattgactactctgagtatcattagctgtgattaatactcatggtatgaaagcagctgatggaagcagatgcagagacccagagtcaaacgttaggaagagctcggggaaccccatagaagaggaggaggaaggatcataggagccggagaggtcaaagtcaccaggagaacatggcccatagaatcaactaagcagggctcatagagactcagaaaccaaagccacaaccacagagtctgcatgagtctgtgcaaggccctctgtatacatgctgtggctgtttagttttgtggtgttatgggactactaacagtggaagtggggtgggggatctctctgactcttttgcctgaacgatggacccttttcttcctactgggttgcctcatccagccttgatatgagggtttgtgcccagttttattgcatcttgttatgcagtgttcagatttttctgaagggaaacagagtagaaatggatctgggtaaggatgctggaaggaggggagggaagtgattgcatgagagcagaataaaaagaaagggggataatttcatatttatgaggacccgagctcagttcccagcatctatctggcagctcacagccacctagaactccagctccagggaatcccaatcccctctggcctgtataagcaaccccttcctccacacacacacgaggtgcagacatggacacaaatgcacacatgcaaatataaatgagccttaaaaaaacagagagccatttatctgagccaacagcaacctgtataaagaaaaatatgtgcacatcaccaaggaatatctttgcccttggaaaagaatagctatttgtgcatgtctctccaagaaaagccacatgaagaaaaacagttacttcggtggaagaagaccaaggtatggaataacagaaatctcccatggcttttcaagagctaaagaaggactaaacctctgtggttggcagagaagggaggagggaaaaacaatggaactttgtgcttcacagggcagcaggcatagacagaggccttaaagatgtatggagtggtttgtcagctcttcatagcccagcagattagacatgcttccccaaaactatcctgtgatattaaggtccatttacacactctataaagctcctcctgtgggtcctggcaggcacactcagagttgggatgtacgggctggttgatttctctgtgacttatgtgatgtggacatggttgaaacccaggagtgaccaggatggaagcttgtgtaggactcagggctgaggctcctgcatacaagtcatattaatcccgtctgagcaaagtggtgcaaattactaacgctgctacgagaagagaattctgtcacagttcctaatgaaaatgtcaggagcgatgagctgtcagtcgctgtcctgctgttccaaaggcaggtgtttccctacctgttatccaaggacagctatatgctgctgcctgtggagaaatcagcagttacttgtgctgagaggaccagaaagtgagagaggacagtgaagctagtcaccagcaggacatggcaggccgtttgtggaggagaggacaccgggaagtgagcagcacaggcttgtggggaagacatacctgtcgcacactgcctgtgtgcagtgtacactgctattgccacacaggccagcctgccctgtggatttggaggttgccctccagggcagctttcactgagtcaaagtcccgtttgggaggctgaggcaggaggaccacaagctcaagactgggtcaccatggaaaggaatggagtttgttatttccatagtcatcctgcaaagccaggttcaggttagggtctgatgtcaatgctggtgtcttatgtcagcagtttttggtgtccctgtgttctcttgtccttcttttcactcatccagttctcatcaaatggctttgggcaagtcactctttctgagcctctttgtccttgagtctacctttgtagtgtcccctgaatcctgcccatcctccccttgtcccttgtttgggctctgctagcatggatcctccctctcctcccttctctccctcccctccctcccactggcctggactctactgtcttgatttttctatctcttctcctttgaccttaccccagtacaccaatactaaccactaatgccattgaataggcaccttttccatgccaactccttggatcactgtgcttcatgttacttctaatattgttggcaagaacctcagatgtatattactgcttcctttgtgcagcttgggagacccccaaaaggtacataaagtgcccaaggtcatgtgtgataatgagggataagctcgcattataactcgtggcagatggacctcacagtttatgctcttctctgctcatgctgtgtcctctactcacaaccttcagtggctcccattgctcaatacatccatcaagtcttctttcttggcatccaaggtcctaggttgccaagcctttccctttcccttgtcactcattccgcattttagttaagaacccagatgaacaagcggaaggccctatttttatttacacccatgctttctttcctgcgtgctttcttacatgctgcttcctctgtcatgagcaagagccactcgccacctcttgtctctctttcttctgtgtaaggaaatgttgcccaagacagcactgaatagacttgggatagggattcatttattttctggcctacaaagggtatgctggatctttattaagcactatgaaatgtactttaaataatatttctctttaatatcatttaaagacattcagagtgaatcagaaagcaatctgatgatgaactacagaactggtttccactgccctcagactctgagaatgtgctgcactgattaactgagactgagctctgtctgaggaaggtgatgacgaaatgctttacctgtcacaagactgatctgtgctgtctgaggcatcactctctgactgcaagctttcattttcaaagcccaggcacggcttcaggagcagtgtgaacccttctgtgaggaagtgagcactgagaactgtcaagttttcagtctcagtgtcttcagctttaaaccccacatttagccatgatttcttttctgctgaagttggacatccttcctgatgaatccttttttgataaatacaatagggttaaggtgaatttgactgagatgtatgggttggttcagcgaaggctgacccaggattaagtcttaccagccctgacattactttcatagtcagagtaagaaatgggagaggagtggataaacacagagttatcagtgtgtgaatgcatatacacatacacacatgtacacatacacacataggcacacacatatatacatacatatgcatgcacacatgtatacacactcatgcacacacatacgcatgcacacatgcaaacaaacttggatacacacagatatatttgcatacatttgtataaacacacacatacatgtaaatacaaccatgagattcagtgagaacaatgaagcttatgtccctggagtccagtggtgactccaggtttgggggacatggagtcaagagatatcactaccctttaattttgaaggttcagtgtgggatttcagggaagggttgtctctggaaaaactcttcctatcactttgacacttaaccaattaaacttatctaattcaccttaacagagaatctgcttctggttggtgttattattcatgctaatgtttatggggacaacaaattcctctgtggtcacaaagtgggaacattgtggaactattagactgagccatgttgtctggattacgagtacataataaaatcaaatcaggacggaatttattttacctttgtcaaatgtcttaagattgacctccatcctccagtggattagtgtccgttaatggaatttgaggggggcaggataggataatagagaggcagcaagagtgagaaatgaagctgtctgggaaacaatggccttagatcaaggtgaaggagtccaggagcagacgtggtagagttcactattctgagattatttggaccttggccagttgcagagacagctagacccaacaactcccacagaactgagtttttacactcctgaggttcaccattcttctagacccttctgcagatcaagggtgctaccctctctcttcagacatctttctgcctcagaacattcatgtcagatccaacacctctacctaaatccatgggacctgttaggtttaggaaattagaatcttccagattttagaaaggtcaaggagtatatattgcatacataatatttctaaaggaatccatgttagcacctgatgaacaaatacatttacatttgtaccacaaaacgtgtgcattgccaccagcaccaaggccagtaatgaccacaggaagcttcatgtctgaaaccttaggctttcctgccaatgggattattattattattgttactgctattatttggtattaaacatggaaaacctttactgcaggcataagtaactgtgggtatccttaccaattgctttccctaggcggacatgggacaaagatgcagaaagccattcatctatcctgtgctggccctgaggactgctgttccaatctcattccacatgtgcagaggtggacaggctattagagttgatatctgcactctaggttccctgtaggtttggtgagcacaaagtaataaaggaaatacaaactcaggagaggaaggagttagcctggttgttacccttggaaaggcctattcacactgcttaggaaggccttcccctgcctgccctgtgggctacttgcctggcttgagggtcaagtttccggcaaatatgcaagcactataaaacaatccatgaaaatacatcagtcccaaaatttagcagcttgttttctgttttgtctttacttcttacatcatttcccaacagtgtataacctttaaattttatgtcctgttcacaaattccttctgggtaaaatgactaatttcttttttcttgtttctcccagctgaagactgtacaaagaaaaaaaccataattaatgacatatgtttgtgactataagcaggggacagattcagaactgtgcaaatgcacctttatcttaggcccacaacactcagctcccaattaaccttagatttacacgttcagtcaagtgcctctgtctgtttccactggagagctctgtgctatgtgtcattagaagggaactctgatatagaccaggtccctctgcagaatgaaccctacgtcctcttttaggatgttgagccaccatgtctcatactgcagaggggcagtctgtgtacatcatgtatgaggagggcagtggtagccactgaccacagggtatgttttgagtcaactgagagctgggatgagtcacttacccaggattccctggagggaagacatgattttagatgaaaatggtcacaaatattcctctagcacctttctgggtcagcagggacagctcctcagccttcttctccagacttactgaatcatcttaactaagagggaggcagcactacaatgactaatctggaaaaatttgggcattgaattgaagcaaattgcccagtgttcctcagctagtgagggggaggaagactccacgcctgatgtctttctccaggctctaccacaagatggtgagaacacacagcttctggaatgctgggttatagtagaacctgcctcaggggcatggctcttcttgctcggcttaacttggaggagttctcacccagaagtctgcaaactgtaaggccttacagcatccctcaaggcaatggaaagacaaggaaagggattccagagttctggtcaccacccagtgcttgaacctttcacccagcattcttttctatcactgaataaatttgaataatgagatctgcagctcctaagaagtctgaattaaactgaattaaacaataattccagttagctcacatggggtatgtgatggttagtttctgctggctcaaaacaaattggagtcacttgggaagagggaacttcagttgaggagttgtctccctcagattggcctgtggtcatatctatggagcattttcttaattaatgattgatgtgagagggctcagctcaatgtggatgaggtgatttctgggctagtggtcctgagctgtacgagaaagcaggctgaaagagtcatggagagcaagccaggaagcagtgctcttccatgatctctgcttaagttgctacccccaggtttctgccgtgagttcctgccctgacctccctagtgatggattgtgacttgtgaactgtcatctgaaagaagccatttcctccctaagttgcctttggccatggtgtaaatcatagcaaaaaagaagcaaactagggcagggtggtaccaatttccaacagaagtgggatgaggaagccctcacttcaacactgtgaatagccatcttactcttcttccctactgcggacagaggccacggatatgaagttaatatggatttgggctgttacttttctgggaaagccagaggtggctgtgtgggtgatgatagcagaacaggaaagtggaaaatgctacccgatcttacatacttggtcaagggtagaggttgaggtaatgggctaaacagaggtgagagggggaaagaagagatgagaatagccaaggctgatgctgacctgaggacctgtggcctgagcactagggcgccaggaacagggttaagggaaattgaggagaaactgagggagttaagacaacaaaaccagggcaaagacccaagaggaggaactcctgaggctctgtgagaacaaagcccagaagaatcagtcaaggggacatgagtttttaaatagaggttatgagtttggcagagtaaagcaagggagtacacaggcctttaccaagtgtttgaccttgattaggtgtgttcaaaactggttgggtgaactttatctgaaggtgctgttcatgggttactggcagcctggaagatgggagtggccctgcacttttcaaccttaatttcataaataagcctttgacaaggccttctctctgtgctctatcaaacagtaacattctctcattttcctctatacctgtccacactttgttacttggttggctcttaatgagggctctctctctctctctctctctctctctctctctctctctctttgtggcctttatctggacatgtcttcttcagcagatccttacactgtggtgtatagaaaccatgtgcaaagtggctctttcctctttctgaagctgtcccagcaggtatgacacagggaagaaatttgaacactaataaaacatgagtagatagatgtgttggctgttgcttgttttgtcagcttggcacaagcttgaatcatctgagaagaggaaccctcaactgaggaattgcctccatcagattggcttgtacactagtctatgggagcattttcttgtttatggatgagggagggctcggcccactagaggtagtaccacccctggtcaagtggtcctggggtgtgtgagaaagcaggctgagcaattcatgaggagcaagccaataagaccactcctccatggcctctgcagcagctcctgcccatagattgccaccttcggctctagccctgacttcaggatggactctaacctgtaaaatgaaataaaataagcctttcctccctaagttgtttttagtcatggagtttatcacagcaatattaagcaaactaggttatggaaaacttgaaaacaaaacaaaacatagcatcataacccaatcgggtcctaagtcacactaatggtttcagatacccctgtgccccatattagcagaaaaggggaaggaagatacactctttgtgccctcgctgctctgacagccctgtgatttcagctttacatttgctgatgtatgagatgacctctgcatgtctcagcagcaggaggggagccttgatcccctattagacaaaatcagggttgtttgatcttctgtaatgctagcaccttgacagaattacaagagcaagccatgtccctgtgggaaaccctgtctcagaaatcaagacctgagaaggaatacacccaggctagagttctggcctacacacacacacacacacacacacacacacacacacacacacacacgcgcacacacacacacttttttaaaaaaaattattttaattagaaagaagattattttacatgtcaatcccaagtccctctccctcccctcctcccctgcttgcttatagtactcaatgccactttctggcttccacaggttccacccccccacaccatttataatcacatacacatacataaataaaaattaggaaacaacataatactgtagtttttttgttttgttttttgctttttgtttgctttgggggcccaccacccaactcctaaataaatacaggaacccttattcttacttatgaattcttggccttagcttggcttgtttctagtcagtttttctaacttaaattaaagagaaatcccatttctctttaactacattttgcctctagactttttgcctttccttattttatatatctttctttccttcttactctgtggctggctgtgtgactgggtggctggcccctggcatcctcctccccttctccctttcttgctcttgcttctcttttccagatttctcctcctatttattccctctgtctggtggccccgcctacccctctcctgcctagctgttgttttttcagctttttattagaccaatcagatgttatatgcaagaaaaataacacagttttacagagttaaactaatgcaacataaaagaatgcaacccatctatgcatcattaaacaaaaattccatagcttatgtgaatgtaacacatcttaaactaatattccacaacataatacatttattagattttgagaattttatatatgaatacagtatattttggttattactctcctccccaattcctaaaaacccttccaatttcatgtttccctttctttctttctttctttctttctttctttctttctttctctctctctctctttctttctttctctctctctttctttcttttccttccttccttccttccttccttccttccttccttccttccttccttccttccttccttcttacttttacagctcactgattccagtatatattgttcttatactcatagatatggggctatccattggaacagagtcatcctacgggggaccatatctctaaagataaaagatgatctttcccttcccctagacaatcccaactgtcaatagcccctcagcctggggtggggactcatgaactcctcccctatcctgttgactggcttgatcttatgcgggtcttattcaggcaaccactactgctataagttcaccaatgcaggtaccctgtcatgtctagaagacactattttgatctagccctccctaacctctgactcttacactttttctggtcactttttcacaattgtccctgagctttgggaagatgggttgtgataatgtttgtggcttagtacttcacagacaattattctctgtactttgactagttgtttctacattaactgttgttcactgttcaaagaaatttctcagatgaggtctgagagctgcactaatctatgggtataaaaatatgaatttagagggcatttgctactatgtccattttaacaaaacaatagtagtaggttcacccctgaggcctatgagcttcctagccatgggttcttggccagatttacagttcagacaggtgtttcctcctgtagagcaggccttaaatccaatcagaaagcagttggttactccccaccccaacattgtgctctactgaacccatgggtgtaccttgacacagcagcagatgttgtctacagggttcacagctgagtgagactgttgatgatacttgctccctcccagaatcctgcatagcaccctccagtattatgagagctacctggtcagtgacaatttgacttctccaagacctgtgtcctaagtgtgtggtatcttcagcaactatgtcttattatgaagttttggtggtcaatcaagaccaatgacaatagcccatattgtttagggaatctctgggacacctctggccaacaactagagaggagatatcctaatcccaatactgggcttcttatttagcaattcatggcttctggaagagcattattaaactctgatataaatatataaatcttatacaatgatttccctagggctatttcaaacatccttatgctagttatccctcacaccagcctgctttgcattcactgtcccatacccttccctgcttgagcctctatctccattattcctattttccccttaatatcacttgtgttcaaaaaatgaaaataaaaagtttactcacaggaatttttaagtttattgttgttaactctattcatcatcccatacaaaaactcctatctaaaactctgtatactttaacaacccctacctcacctgaagacatcattctactcgacacttttgtgagagactttttcagattcgtgtaaggtagaagtcattattgtggtttggcttttctgtgcctgacttatttcacacagcaccatgtcctctaggcccagttttgtttgttatcatggtggcataactgtcttctttaaggtcgaatagtattctgctatgtgtatctatcatatagtctctgtctctctatctatacactgttgatggatacttggactaactccattgcttgcctcttattagccatattgcaatgaacacaagagaaaacatgccattgatatgtagatttcaatttctttggatatatatccagaagtaagatcactgtatcatatagtagttctaattttagtggtttttttgagggggacctacatagtcatctataacattgttttgtaaatccattgaattctgaaggtatgctatgtggcagtagacaatggggacatgtggtctccaggatgccatgctctgagttttctttcttttccatagtcactttttgcccttgttcttctctgacttctttttctccttggctctccatctctgctttcactttgtattgtgcagatgtgtagccaagcacatagtagaaaagtttaataaaactctaggcatccattatccagcttcaacagtgagtgactcggacaggctcattttatttaaaattaattacatttatttggggtgtgtgtatgtgtgtgcctatgtgcctttgtacatgtgcacctgtggaagtcagagaataattcacagaagcaggttctatccttctagtatgtgggtgtcacgattgaacttgggtcattaggcttagtagcaaatatctttatccactgagtcatcttgctgttatcatgttattttttgaacagatttcttagctacttttttcattatgatattctctaggctcataagtaaatattgcttgtttactcaaaattcctcaatgtattacctacactttgtgttgtggctctaagactagactctggtactttccagtctggattcatactatggctccaattaaatgaacctaaaaagcaagctgatgtagctatactaatatctaacaaaaccaacttacaaccaaaattaaacaaaagatatggagaagggtatttcatactcatcaaaggaaaaatccaccaatataatgtctcaatcctgaatatctatgtaaggatacccatatttgtcaaagaagcatcactaaaacttaaatcacaatcaaacaccacataatgatagtgggagactttaacacaccactctcaccatttgatatgtctttcagacagaaatgaacagagaacagaagtaacagatgttatgactcaaatagacataacagatacctacagtacatttcatccaaacacaaaagaatttactcttttctcagcacctcttggaaccacctccaaagttaaccatatactaagccacaaagcaagtctcaagaaataaaaaaaaattgtaataaccccctgttattagactacctgtaatcagactaccatggattaaagctgactatcagtaacagcagaaagcctacaaattaatggaaactaaacagctctctattgatttaccactgggtcaaggaagaaataaagaagttcaagacttcctagaattcaatgaaaatgagtgcacaacatatccaaacttatgggacacaatgaaagcagttcaaagaggaaaattcatagcacttcgtgaagaatttggagagatctcacacaaacaacatattagcacatgtgaaagttctagaacaaaaagaagcaaacacacccaagagttgttgatatcagtaaataatcaaaatgaggactgaaatcaataattagaaacaaagagaacaatataaagagtcaacaaaacaaagagttagttcttcagaaaaaatcaacgaaatagataagcccttatcccaactgaataaaagacagagtgagaatatccacatcaacaacatcagaaacaaaaagggggcataacaacagattctgaggaaatccagagaatcattaggtcatacttcaaaaaactataccacacaaaattggaaaatctaaaagaaatgaacaaatttcttgatagataccacttaccaaagttaaatcaagatcagaaaaacaataaggaaatagaagcagtcatttttaagtctcccaaccgccccccccaaaaaaatcctagggcaagatggctttaatgaagaattctaccatactttcagagacgagctaatgccaatactcttcaaattatcacacaaaatagaaacagaaagaacattgccagattctctctgtaggacacagtcatcctgatacccaaactacacaaagattcaacaaagaaagagaattatataccaatttcactcattaacattgatgcaaaaataatcaataaaatactggcaaaccaaatccaagaacacatcataactatcatttaccatgacgaataggcttcataccagagatgcaggttcaacatacaaaatctgtcagtgggatccaccatataaacaaactgaaaggaaaagaaccacatgatcatatcatttgatgctgaagaagcttttgacaaaatctcacacaccttcatgttaaaagttttggagaaatcggagatacaggaacacacttaaacataataaaagcaatatacagaaagccgattgccaacatcaaattaaatggagagaaactcaaagtgattccactaaagtcagaaacatgacaagggtgtccaagttctccatgtctaccaatatagtacttgaagttctagctagaacaataagacaactaaagaaaactaaatggatacaaattggaaaggaagaagtcaaagtatcattattttcagatgatatgatagtatgcataagtgacccctaaaactctaccaggaaactcctatagctgataaacgccttcagtaatgtggcaggatagaagattaacaaacaaacaaacaaaaatatcagtagccctcctatatacaaacaatcaatgggctgagaaagaaatcagagaaatattaccctttacaataacctcaaataatataaaataataccttggtgtaactctaaccaagcaagtgaaaggactgtatgacaagaacttcaagtctttgaagaaagaaattgaagaagacatcagaaaatggaaagacctctcatgctcatggattgggaggattaacataataaaaatggtcacgttaccaaaaacaatattaaattcactgaaatcccaattaaaatcagaacttgaaagaacaatactcaactccatatggaaaaacaacagcaacagcaaaaaacccaggatagctaaaacaatcctgcacaataaaagaactttgagaagtatcaccttccctgatttcaagcttattacagaactatagtaataaaagccacattggtattggcataaaaatagacaggaaaatcaatggaattgaattgaagattggatgtaaatccacatacctatggacacctgatttttgacaaagaagccaaaatcatacaatgggaaaagggaagcatcttcagcaaatggtgctggcctaactggatattggtatatagaagaatgcaaatagattaatatctaccaccctgcaaaaactcaaattcaagtggatcaaagacccaacataaatctagatacactgaacctgataggagagaaactaggaaataatcttgaatgtgttggcacaggagacaatttcctgaacagagcaacagtagcacaggcactaagattgacaattaataaatgggacttcatgaagctgaaaagcttctgtaaggcaaaggacactgtcaataggataaaagagcagtttacagaatgagaaaagatcttcaccaaccccacatttgacagagggctgattttctttatgtataaaaaacttaagaaactagacatcaacaaaccaaataatccaatttaaaaatggggtacatatctaaacacagaattctcaacagaagactctcaaatgattgagaaacaattaaggagatgttcaacatccttagccattagggaaatacgaattaaaatgactctgagattccattttacacctctcaaaatggctaagatcaaaaacacaagtgacagtacatgtggagaggagaggatgtggagcattcttccattgctagtggaagtgcaaacttgtacagctactttggaagtcagtgtgctggtttttcagaaactgggaatcaacctatcacaagatccagttataccactcttgggcatatacctaaaggacgcacaatcatgccacaaggacacttgctcaactatgttcacagcagctatatttgtaatagtcagaactggaaacaaccttcttgtccctcaaccaagaaatagataaagaaaatgtggcacatttacataattgaatattactgtgagcccaggtaagctgattctgtgaattttcttgtgatgtccttgacccctctgtctcctacaatcctttttcctcctcttctgcaggattcccggaactctgcctaatggacccaggaaattggaaggcaaatggatggaactagaaaaattcatcctgtgtaaggaaacccagacccagaaagacaaacatggtatgtgctcactcataagtggatattagctgtaaaacaaaggataactgtgatgcagtccacagacccagagagactagagcaaggagggttcatggtgggacccctgaatctccctgtgaaggggaaatagaagagactttgtgagtagactgagggcagctgggaatggaatatgagcaatcaggttggaggacaaagatggagaatactgaaagagactacggaaagtgggggacatttggggatcaggtagaacctagtacaagggaatctttcaggaatctacaaggatgaccccagcaaaactcctagcaatagcagatatgtagcccgaactggccatctcctgtgaccacattggtgcatagcctaattgtcatcagagaggcttcatccagcaactgatggaaacagatgtgtgaaagacatcctgcaacctgaaagtgccccaagcgagccatctctgtgccaaagatgtacaagctcccttactcccacctgcagcaggatctttggtctctaaggagtccaaggactatgtagactatttatgcctacatgaagaatgtgttctgttgtgttttaatgccataaatcactctgcaccacaaagaagaagtgagacttgaatgtacatcttggtcctgccacttcctagctttggtgctctggcaactccctttgcctctcgggaatctcagctttctcgtgctaaagataacaacactcttgaggatagttacggaaattaaataacataatgagtgtgaaatgcttatcacagttccttgtacaaaatagatgcccaatacattttattacctgtttctacccccattaaatccaggggaagactcaacacagcagaaaacataaagctttttctcaagatcccacagacttgctcttgaagtgaagatttatgaatcaaattctattttaaatgtacaacggagcttcttgacagagttgcttttccctaaaaagtcactgtgggtttggcatcttgttcagcccaatggggtcccagggagctgaaccctaatgacatgcagatgtggcgtgctctgtggaaatcatgcctggttccagatggagtttagggaaaaggacggccggttcctgttgaagacatgggaactgtggctgactgagctggctgggaggagggagaatagaagaggggggtttcggggaaaatacaggtcaggagaaaggaactttggattcactgaaaacctcctggaagaacattaaaaacagacaagggaaaaattaagcagacaaaacaaagaagaggaagtttaggaaatagccggaataatagctgttatcatgaaaccctccatttgttaagcatctggtgcagggtgggcctgagtcagatgctttaccaacatttagtttattctccctctttgtggcagaacagttattgttactaattattgataggaaatctgaagcttgagaatattgcagccactggctatggagtagtggagccaaggttcagtttagcatcaagcagccctgttctcttcatgaggaggtcctggaaggaagcaacaacccaggactccaagacaacctctccccaggaaagccagtgaggccagggtgtgagcaaagaatgatttttactcaaggctgagaaggagacctaaggttgtaaaggccaagaacagttgcccttcctcaacaaactacggatttgtggctacttgctttagattcttggatgtcttctcaaatgctgagcttggcattcagacaggaactctgggaaggttttctctttacaaggtgctgaactcttctctttgtctcttaaggacaacaaaagacaattacccaaacccagggtggtagcatccatctgggcctccccacaggctgtggaggaaggctatggtgacctctaagggagtggaagtaacatccctcttcatctatcttttctccaaatctgactggtcatacaatagattttctttctatcagatgaaacattaaagaatagatttcaaaatactttgaagacacctatttactttgggtgatatttaactctgtgaaatgacagagtaggggagatgtttggacacctcaccatatgtcttgtaataggaaagaaaatttgaactgttttacttgtggggtgggtggtggatacccacagcaagtgtgtggaggtcagaggacaccttctgggagttgggtctctccttccactatggtccaggggatcaaattcaggacatcaggcttagtggcaagtgtcattgtccactgagctatctcagtaatccaagaaagaattaagaaacattatttagtgcatcaattttatttcaaaacttaaaatatattgtcattgttaatttggcagtttttattctagcaggcctgaaaagaatttcatatgtatgtagtcacaacaaacaccacccagtggtactgtggcggtggggttaggattacgatttaatttgttttgtgctgaaaggcatggctatgtacagagccttcctataaaacccttcgaatacccaccgccccatgttctcagcatcctggaggaccaggccatgtgtttttcccccttagttcacattgtacaatctcttccttgtgtgtgaacttcatggggagtcaaagagcccattaaaaatgaatggcatatgtgaagcattctgcaaatctcgaatgatcactgctttggaaaacagcattttgtggtgtaaactagaaaagcaacatgggatctgtcatggagagaagcaaaaactggcaccataccaagaacccagagctgggtcttaccctcaggagacatggaagaatagcaacggaatcggttttctagttgcattggaaccttgatgaaccaggaaatcctttatgatgcttgctagacatttgtgctaagtcttagtctcagggggagcctaggtgaaatcctatactcaatgttaggccttagcctgtttcctcaatagaatgactacagtcatattattatgacttattcaatcttcccaagggaccctcctcagcagctatagtattatgggcattgtagaacattttgctgtgtttatttaatttcagcagagttcttctactatgctaaagaatagagaagcttttcttttttggaggattatatgtgtgtatggtatacgtgctcacatgtccaagtgtgtgggcatgcatgtacacagaggctctccttgattgctttgtactttgctgaagcaggacctcttgctaagcttgtagcttgtagctcagataggggaatcccctgtctctgctcccaggatctgagattataagtgggttaccatggccatctgacttttatgaggacttgggagatcccaatacagttctcacggctgtgtgtcaaggattttatccacttagctatctccctagctcatgaacatccccaaaggccaacctagagcctataggtatatgtatgggtgtcgtgggatgcacacccaaacttgtttgcactgttctcatgcacactctctcaaagataatctcaacgattttactttacctttgaaagtatattttatattttctctcatttatagatttttcacttggaaaaaaaagaacttcaattatatgcctgaacccttaaaatgaatctcttgactatgtacctggctgcgctctcttcctgagaatgaacaagaggttcgccttttctccatgtctccttaggaaatgatgcccatggttgtggctgggaggtctataagaatctcagcagtagcggggcggggcattggtggcacatgcctttaatcccagcactcaggaagcagaggcaggctctgtgagctcaagaccagcctggtctacaagagctagttccaggacagcctccaaagccacaaagaaaccctgtcttgaaaaaccaaaaaataaaataaaataaaaaatctcagcagtaacccatgtgaacaataaatccagaaaaaaggttggggagggaaagaccaatggcagtcatctgtagaatagcttccaaaattctttgactaactgcattctgttcctttcaaaccccacgttacacgtaataatagtactgggaagtctttctgagacgcacaaattctgaaagtaccatccagggttgaggctgtagctcagttgctagagtactcacctagcatgcacaaagccctgggttccagcttcagcgccaccataaaactggtgtggtatttcacacctgtaattccaccattagtcatttgggagatggagacagaggatcaggaagatcatccttgactacacagtgagtttgaggccagcctcagatatatgaaatcttggttcaataacaaaaacaaaacaacaaacctgtaacattcattgagaatctctggcaacatttcccaagttggggaagaatcagatgaagatgccgagagaccgggagttcttggtgtgggaaagcatacactgaaatcctgttagaaggaatagtgggagaatggatcagtggttttgaactcttgctgttctttcaaggactggagttcagttctaagtacctctattggttggcttacaactgcttgtaattccagctgcagggtatccaatgccctcttctggcctccacaagcatgtgtgtgtaggcatgcgtgtggacatgcacacacacaattaatactaaaataagtagataaaatctttttttaaaaaataaagggacaagtaggaagtacttgttcccacaaggccaattgcttcctaatgagaatcttgttccctagttctacatgaatcccagaatggactataaaggggaggagggtttcttagaagagttttcattattttcctctgctgtatgagcctcacggatgaaagggttttctgatagagttgagggttcacaactattggagcatgtcaaccataatcaagcatcactattggctgtcatagaagagcttcagttttaaaccttattgttttctctacagtagtgttcccaagatccttttgtgccacatgtccccagtgcccatatcaatcgccagcccggagaaatccacatctaactttcattcacttggagaactgctttcctttctgagaaaagagctcttaccttttgccgagcagtgagctggaaccttaaacagaatgcagagagacaggagctgggcaggcagaatttgtcataacagaccctgggagtaagagtttccatccaattctctgaaaccctgtttcagaagtctatttgagggggaacaatatattctctgggttttgtgacctacttaaacactgcaagctgtaatcatttgaggatttctaagaaaagggggggggagaggcttaatataatcctaaagccaggttacccaacaaccaagttcaaggttgcagttgtttctcaattggttaaaatcttctttggtaattactgcacgtgcttgcttgctggtgcaccttaatccacatcctcttcctggcaatgctgctggccatctatgtcggttttcccaacttcacacttctaccaggaagcagtggctcacttttacccaaacccacctcccacctatagcttctcagagattacctgggagtggtttctcccatcacaccccaagatcttcctgtaacctttgaattcacaggacctgtcctccttgtgagttccatgtgctccagtgcagggacacagaggacaaagggcccagcttcctgtccggtggtaggggtgtgttttcactgtctccctcactgcatttggactgtgctgagaggaatgcagaagttggtgggctggccacccatgggactttgggaaacttagcctgacacaactgaccacatttagcctgtggcgggcaatgtgttgtcacattcatccctgtctttgctcttcatggacatttgaattttactttttcttgctggtgccaggtattcccagaggcttttgctcgaatatgttaaggaatgctgtaacccgaagatgagagcagttagcaactgctgacaacctaaggatgctagagtagccatacatagtgttaatagtgtaataatattatgaggtattttgtctccatttaatgagtgagaaaaaataacagcacagctaaatattttctcagagctccctagcttcaagctcttgaccttgagcccatgttctttcctgggcttgggagttaaaccacacagccaaggtttagaaacctcttagcagggcatgtagtgacctggtattctcattaagtctcatctgaaaaaatgacagaaaggtcacaggctttagaaaattagctttaaatgaggccttgaaagtcatgtcattgaagaacccaagatgctcctgaatgcctcattttctccagaccaattcctattgtcgggtgtgtgcacattcatgacattctgggtgctgcatacagttctctagaagtgacccacttgcccctctgagattttctacactagggtgttgctgtcctccaaaggttttagtggtaaagtctgtagaaggtaaatattggggctggggagaatggctctgtcgctaaagtgattgccctgcaagtgcaaggacctgagtttggttcccagaagcctcatagaaaagccaggtgtggtggtgcacacttgtaacatgtgcaatgttctagttgtatttctattgctatgatagcacaccccaagaggcaactaaggagagaaatggttcattttagcttacaattctagcttacagtccatcattgcaatgaagtatggtggcagggacttaaagcagccttgtgagttcccatagtcaataacagagataattcaatgcttgtatatttagtgtttaggctccactcagtttctcctcttatccaaaccccttccccaggaaatggtgccccacaaactgggttggatctccctacatcaacttaatttagacagtctcccacagacatggccacaggccaacccatacagacacccatgatgattctaggctgtgtcaagctcacaattaatgttaaccattgcacctgggaaggcagagggaggaggatctttggccagccagcctggcctacagggcaagttccatgagagagcttgtctcaaattcctgggtggatggagctggaatagcaatgtctgagcttattctctggtctctatttgcacacatacacctgagtatatacacctacacacacacacacacacacacacacacacacacacacacacacgggggggggggcagagagagaggtgcaaacatggtacccctttttaatcttattttaactttaaaaattcacattgaagaattaattataataaaagttgtggcttacttagaactgctgtctcattcaacagaaggcgttctctctctcatggtctgaactgaaactttcaggattattttattaagatctgaagacgtaatttgacatgctgatatacaagcatgtgaatcatcgggaggattagggtgagcttctgtcataattaggtatgccagaaataattttctccctagctctgctcatctctcctcctctcatcgcaaacctgtgcttctcttggtctctggagccaccctctcaggattatctaatgtaatggatttctcttcctccaccccgagaatatccaccatgcccagcccctgacagagccatgtgtacattctgttgccctattggtatttcaaagaactgtaaagttccagcagtgagttctgcacaagaaaagagggtcttgatgagtggttctcttgaactgagggttaattagagcccttcttattcctcttcagttctctctgttgcagcctttcctaatccatgcatgcattctctggtcttcaatggcatgtgaggctaggtaatttggtttttaaaagtctgccttcttccattggtcaactgactgggcctgagtagtgacatatcttcactgagctgtctataaaatggggcaacaccacttcctttctcatctcatcagggctgtgtaatcctagacataaagagagtagggctgtcttatattttattttgatgaatgacgatagctaccacattctaagtgctcaggaccaggtgctccatgcctgtcgctatctctgcaggaactttacagtgtacttctttttatagcgggaaaggctaggctttataggcaagtgcagagggtnnnnnnnnnnnnnnnnnnnnnnnncagcaggatttctcagaaatttgaagacagagattattaaactgtaatagtgtcttaaaagaggctgtcatgaatcaaggctgttttgttcccttcctcctcctcttcttcctccactttctcctctttcctttgttttctcctctctctctctttcctcattcccatctctcttctctcttccctcctctgatcctcttccttctcctctcctcttccttggattgcagaaggaaggatctcattggccacattatgtctcgagtcaggtctcagctcactaactggctttcctgctctgggtagcctcctctggccctgaccatgaaggtgtcataagtcctgtggaaagcatctttttctcctttctcagtcaaagttccctatattttattgttgctttttaggtcttaatctactcattccaacatttttcctctttccaacacaattctcaacaattagaaaccttgggcacattttatgacacaggtactaggaagcagcccccttgttcttgatattccaatttaccatttttggtaccagttttccaatttaatatattgttattctatgtttttgaaggaagtagtgaaacatgtcataatatttcagaaagtactcttcttattaacagatgctattatatctcaagattattgctggaatatctgtaatttaattcaaaatatcttcaaaggaaaaaaatccaaggttgtctaagcagtgtgaaaagaatggctaatttgccaggacggcctgtagagtcaagagcgggaggggttagacttgccttcctttctctgtttacttggttatctgttcttcttgaaaaatcttggctattgtcaataggaaactgatatcattcacttctacacaaactactgctagtgggtggtccctatatcagcttcaaaccagagtggaactgaacccagtcaatacctgtgataatcttcattgttactgaaaagactacttggacatacttgaaaccttgtcacactgtgctggcatacaagaccattttcagctcaacctccaggttcatatgctacttctttgtccctccctccctccctccctccttccttcctctcttcctcccttcttccctccctcccttccttcgttttttccttccttaatttgttttattcaagtctaaattgctctgtgtagccctggctgtaatggagctcactctgttgaccaagctggccatgaacttggagattcacctgcctctgcctcctgagtgctgggactaaaggcttgtgccaccacacctggcctatttatatgcttcttaaagcaagtgtttgtcatggttggaaatttactttccatttttatcagagtacctcacatgtctcttcattttatccataaagtacaagcctgtacttcattagtgaaactctagattttttagatgtaaacttgactgtaaagcatggtgcatgtgtctttaaaacttcaactctatgtcgggcgttggtggcgcacgcctttaatcccagcacttgggaggcagaggcaggcagatctctgtgagtttgaggccagcctggtttccagagcaagtgccaggatagattccaaagctacacagagaaatcctgtctcgaaaaaccaaaccaaaacaaaaaaacttcaactctacaatcctggcaaatcatgtagcatgcatgcactaaagctgggatcaagaacttctgaggggctaaatcttggctggtccagtacttgtctagcatgtgcaaggcctgaggttcagtccccagaacattttctgctgtgtgtgggcattaggctgtagcagagtccctctttctatatcccacactgctgacccttttgtatggagaaaaattaactgcctttctttatatgcagactcaacaaataacacctgagacaacaatttctttttttagattataattgaatcacaacatttcttctaccctccaatccttcccatatagcccttccttctctccttccaatttgtggcctctttttcactaattgttattgcatgcatgtgggtattggacactagttcttagtagcagctgtcgtcctacacacttcatctcaattctgacatcagctgaaattagtgcaaagcctctaagttaggtactcagtccctcaagactgtcccaacctcagatactcctcataagtggggtgttcttagatcacccacaaatcctgtcaagtttggctacaaactggaggttcctataacccagtctctgtgtttaattatgtggcagaatgactcatagacccaggaaagtgctcaccacaacccatttattataaaagatatgacccagaagtagccacatggaaaagctgcacaggcctgggtacgtatggggctcccacaccctggcagtcagtcacttccaggtacttctgtgtaaggggcaatctggaaactctccagaccctgccgttatagttcttatgaagtcttcactacagaagcatattccttataccaagtgggtcccagggattgaatttcagtcctcagtttgagcctttatccatagagccatctcaccagcaccacatagttcttattatgtcatgtcatcacagcctctctgggcacaccccttcttcatcttctagcatctccttttagtttaagttagtttaagtcgtggctctgcttcttacaaaccacagcttggggcaggtcagttaacctcttgttttcctcagtctagaatgaagtaagttagttgtttaatacatgttgggatgtccactctgaaaatactttctacctcatttgttttatttttgaagaggattatttaggtctttataaacgtcccttaatttgaaatagtcttttgtgtatttattaacttaaccgaggttgtccccttgattagaatgctgctgacatgacattgtatccatgttcgcctagacatcacagggcacatgacaccaacatgacttactactactggttgtaccagcttttgacactctctgaagggcatggtctcaatggcaactattattttctctttgtactctcatgtggggagctaacacaggcactgcaagaatctcgtttgtgtttgcttgtgccctacttttgactattatttttagcagtatctgatggttcttacctacaatgcttattacataacacatgcctgatactgatttcctaattcccctaatttcttctaaatttattaattggaaatccattgtaagagctggatctttcttcctaattctgtattcatctatgtctttatttgcattatcaggactcaggtgtcctaatggaatactgtaattattttgtggcttaaattgaacaagattggatctccgagagcttcaagttgcctttctggccttccctaaacagaccagcacttcaaataccgttatgtggcagtacaggtggttccacaggtgagttttcttttctcagccctggacttggtatcaccattcctttggctaatacattccttctattgaagactggcacttagaaacatggtggggcagcaggtacacacagtactgcagcctggtgctacccttctcagtcagaagatcgagaaagtgtgcacagcctagttgatttctgcatctgtttatacgtccatacattaaaaaccacacattcgcacctctgaaagcagcagaacaacacaggcttcattctagcttttctcctttccttagctatagcatttggctgacagcaaggaaccttgatgtatttacttattttttcctacattttttaaataaaaatattttgattgccataactgtgagtacagcactatgattctaggcacgtgtgtgatgtgtaatgattaaaccagggccattaacatcctcattcctccagggttcatcaccctttgtgaatggagtctttccaatcctcccttctaatttctcataaaatatgtaagaaatattttcaaacaatagttgccctcctgtattgtcagatgccatcacttattcttccagtctaatggtatctgggctcattgtttctaatcctaagaaacaacacataaggttatttcagaacagccctgtgttaacctgcaggacaggaattgtgtgcattgtgttctttagcccattgtatccagtcaaattgtgctgtttaaagatgtgctgattcttttttgactttcccttcaatctggtttatgccgatgattgggatgcacgcagttaggtttatctgtcactgttggcgctacatttcaggttcccgtcatatcttggccgtcttttcattattttttctgtggtacaccaatcatgactctagaataatggtgtagttgtaacttctcttttactgtgacgaaatgcttggcaagaggagcatgaaggaggattgcttgttttgcttcacagtttgaggggaggggtagtgatgagagtgctgatggggcaggagtgtgagccttgttgtgttcacggatgggggacgagggagacagtgcttagcttactgtcttcatccctcttatttagtctgggacctctgcctatggatgatgccattcactttcagggtgggtcttcccccaccccttagtcaaacctctctggagaaccacccttgtgccccacatggacacccagagatgtctccttggtttctaaatccaattgataagagaagttaagcatcactcataagtagaccccacagcatttctaaggagcccttgcttccttccttactctcacccactccctctagggtgcatttcattcacttctgccttatccttcctttatttcttttgtatttattcaaatgagcaaatgtgtacatattttcttctatttctccattttgcatgagaactttttttttttactaaacttaaaaaagtttacagaatgtcttagaaatcacagatgtcctccatattctattttattgatgtgtagtgttccactgcctggaagtaaagatggcttgaacttttcagttcaactcagccaccagctgaatgctcgcaattgacacatagcaaacgacctgagcagccgaatcttgcccaatgtcctggcccacaacataatgagacatggtgaaacagttgttgttgtcttgaggtagattgttaacacaacaatgggtaccattattcagcaaaaaaggtgctatccatttataattccaccaaagacgtcatagctgaaaacatgttacattgaaatgcatttggtacagctagcctgtgaaacactgcagctgaagttgacagtctagtctatagtcatgatactggggagactggctgtcattgcccagtgactccacagtgctatagtgcatatcttgaacctagaaaaacatcaaaatttacaattttgtacaatttctgtgttatcattttgttttaagttggactggagatgtgactccattgatactttcctttccttacatgtatgaaactctggtttcagtccccggcaatgaaaaaacctaacatgttggttcacacctgtcatgccagcaatcacgaggtgctaatccttgactatatagtgattttgaagccactctgggctacctatcaaaataacaaaacaaacatcacattaattgacttattcaaaagttaaatgtcataaaatcacaaatcaagcattacctgtacatgaaggtgtttggagccttttcctgtagcataactttccccatctaccaactctgtgactgactttgggctggattccttgctccttggtcctgttgcaccaagactcctgctaattcagcatggcgagagctaggaagcagaggcttgccctgtaggcctgctgacactcctgtcctagtggcagagcatccaagctgtgaaaagtgtctggggtagagcaatgagtcctcctctgtcccactctgctctgtccctgcagtgctggcctcctaacagaccttggtttgttacagcctctctccacagaggcctgagtgaggctgaacagcctagatacatagggaagcctgaacctgccagactgtccaaaggccaagggtattggtatctcacagctcatctgtaactgattcctggcattccatagatgctggtacagctgtgagtagctttggattaagacaatcttagttgcgtacctcacattttctaaattcttaccacatattctaatttctacatgcttgatcactccttgcccatctccttttgtttcccatttaactccagccttttccagaatcttaactcagtcatttttagggtgcttgctcctgagcggttagttggctctccaatccatttcccaacatgtgcatattttactgtgttatagggagatccctctgtgtctggggaagtttacttggtggaagacatgggtgggaagctagtggtctctgtggcatctacagtggtggctgagtcctctgtgactctagttcctgtggaccgtcactcacaacatggttctagcgtttgcctgatagcatggcttctgagccctgctccaccagccctgggatgatggcagtgtctgctacttttaatatctgtttgtgcttgcccagcatgcaccagggcccgggcttgattcctggtttggcacaaaactggttgtagtggtgcacgcctgtcatcttagcacctggaaggtggtgccagggggattcaagtcaaaacacacacacacacacacacacacacacacacacacacacacgggaaacgggaaaattacagagtgttctgttccaggactgataatgttcccaccacactactagttgtttatgttgcctgcaatatgcagcacttgctcaaactgacccctgtttctcagttgctttggtctcctctccttttttacattccatttctttccccttggctgaaattttcttcgttgttcaatgtagttttagtttttgttcggtaatggccaatggtttggaaaacttggatgtttagagtgttgaagcagatagccccttcttaggaggttcagtttaaggtcttccaatttcataatggtgtgaaagccatatgtattcaggagaaactatactacaaactgcaaattttgatcttttccccaatcggtgatgtccaatatgacatttttacaaggtgctgggcagcagccgtgagcacaacatcaggcagtcaggcattcccagggcaaacaatggcactgtgtgtggtgtactgtcactaagctagtgcttgataggactgtgtgtattaaatgcactgctgatgtttggtattttctgtttgcaatgagttcactggagtgtagccttaccatcaaaccaaggaatatctgtagctttttatcatgtatttgtgtgtgcaggaagacatgagaagaccagcaagcagaagacaggaccacctacacttcacatctgcattaatttgatgagttaattaatgttacatactttcttttacttacagattcaatgtccccctcatgtatcaactgtttccaaaaatcgctttgggatccataggaaggggaggggattacaagtcaacaaatgagaaaatttccaaaataagacaatggaaaggaattgaatattcagaagaaagattcaaacacacactttagaggaaggggactatgtgttcttcacaaagaaataaatgccacattgagggcttgaaggaggccaggtagtggtttaaaacatttgaacatcattaggatatttccttttctgttcattttggttttcattttcagaaatgacagcatgaaatttggtcactgatggaggggccaattttactattaactataagtaatgaatttcctgctgggcattggtggtgcacacctttaatcttagcacttgggaggcagagacaggcagatctctgtgagttcaaggccagcctagagcaagttccaggacagcctccaaagccacagagaaaccctgtctcaaaaaaaaaacaaaaacaaacaaaccaaacaacaacaacaacaaaaagcttcctcagcatttttctttatgcatgtatttaacctgtaactttgaagagcgttcagcttgtgtaatggactgaattgtgtttttcagaattcacattagaattctagtaacactcaatgcaactgtgtgaaagtgggccttaaaaagaaaattaattttaataagagtgaaacctgattcaatatggcttgtgtccctgtaagagcaagagactcagggacatgcatgcacaaaggaaaggacatgaagagagaagatggctcttggcaaacaaaggaagaaaccttgagggaaactcaacctgctgactcattggtggtcatccaggtctatgaggaacaaacacccattgttgcagtcacacaatttgtggtacttaggcatgggggctccagttgcctattacagctaggtatagaatgccaggtccattattatatgtttatagtactttaagatatttgtcattgaaattttggattatgtctctgtggcttctggattgtgttcccaaatctgttttctagttgggaattctcatttttatctactatgtagctcatccatttgagttttagaggcttttaggtaaggctgtgaactaagtttcctctttatgaatcaatgaaggacaagcgtcagggtaaggaaagatggaatctatcttaaagagagggtagctttgacaacccatggatggagtgatgggacagctgaaaattgcagagaaataacagtgatggctgaaagaaaacaaagacaaccacagtcattttactccaagctggagaaaggaatcagatgtctcatccaaaagtggagtcaggaggccccggtgagaaaagactggtcatcctgtccataggacaagcctacctctttcacaagcctcatctggctgagggtatttcctaagtcagtgactatgggaatcagcatggaagtttctcaaaagactgaaaatggtactaccaagagaccaagtatactactctccagtgtatagccaaaggactctaagtcaacaatcagcaaagatatttgcatatccatgtttatagttgctatattcacaacagccaggaaatggaccagcctagatgtccattaatagataaatggatttaaaaaactgtggtacatatgcatagtggaattttatgcaaccataaaaaatgacatttgcaggaaaatgtctggaactataaagattattatattaaccaaaattctctagatttaaacaaatattacatgctttctttcatatgtggaaatgtgtgtttctaggagaggtaaggagacatctaacgggagaggaaagggagcaagagagtaatagaaataaatatgtcatgaaggcagaagggagacaacttggaaggaggaaggaacttgcaaagggagatggggaagggtggagggtacaaaatacaatgatatacacatggggaaatgccacaacaaaactcacttctttgcattcttgaagcaataattaataaaaagtatatatataaaatgtacacgaaggtgacaaatatggtactgaagctaacagaaggtaaaaacaaaatctcttcttataaaataagtaacttttgatgcctttaccttgccatttccctatgtaaagggatcaatgtttatctagagtagtcttgtaatgtgagttctgggggactcaggttctatacaatgttctcagcttcattgctctgatcactgggacccaatgctcgctttctgtgtccacatgagcatatggaatagataatcattgcctgtggccataccacagcgccattgcgaatgtcattgtgagccacacttggaagctgttctgtgctcaattatctttttgcttctagacatttctttctgaaggattagctgtgaaacaccccatggtccctcattaatatgaaccattttcaaatttttctgcgttcattaaaatttttaaataaaatttatgtggaaaaaatcaataaacaaacaaatgaacgtgaattagatcatctggcttttgcttcagtttccctggtaattacaaattatctcattaaaaactatgaaacatttaaaagttgaatccaattctagtctgccattttactaaatcagaaaatcttgaataatgttttgattatgaggggtaaaaaactaactttagagaaaggcacttttatgttgttctggaactgaggaaatagaaaagtgttcttctctgccatcagagaacacctagagtgatgtttccctagaagtccttgtgaaatagcttgtcacagcattacacctgagttctagttacacctgtgtcactggctcaaaagagcagggtaaaccaggacctaatcaatttactaatctatacttgtacttatattttattaatgcaacaacaaaggtgtgggtatgattgctgatgggttaactacccacaggtcagcagctggaggctggactggagttatccatcacatagatagattttaccagacttgctgaagtgcaaaagatagagaggttccgtggagtcttggtggagggttgtgggtagcgggttctgagtgagagaagtgtaggtggtatcagcaatcttaaaaggtccttcaggaaatagggttcctacctgtgtggccccagtgccttgtgtggaatggagacaaacatgcagtcttcctgcatcctgcacaagacattgggagccttcgagcccctctgcacaatctttgggattgctggcgagcagccctgcaggatccatggggtcttgcccttctccaaccattcgataaatagcactcagtagagactttggctgcggatacttgttttcacaacaacagctccgagccaacctccttaagcagctccatatgtttctatggagagtttatggatcgtggccttcggaattcttttgtttatcactgggaatccaagtcttgaaagctgttaactaaccatgaggctcactggttatacaagctgttggaccttttaaggactttgacatagggaccactttctgccgagtaagaattagcggtttaaaagaagtgcacttaaaagtaccatgtaagtatcagtttctgtatgtcattacaagccggccttttaatttaaaaaaagaaaaaaaaaaaactggactgcactgctttgtgtgcacacttaaacgaggcccttaaagggaagtctgagcacagtcttcaaaagcttgcaatcaaaggatccttggctgctgttgtttgcagacgaatacctgaggccaaagcaggatgcagccttcgcctcctggttacaaaggcactgctctcaagatgatcaagacccaggatccgccccctcccaggcatctctccctactctgtccctcatcccaccctcactaatgtaatgccaaccacatgggggatctagaggtttcagtggagtgcctcatcagccttaagaataactactatttattgagcactttgggccaagctctgcattctcctgattttccatctgtcttaatccttctctcacaaggtggagactataattattcctcattttacagataaggaaatccaagcttagagagtttgagcgattagcctacatcactcaagagctatattaggccgttactcattaactaccagcaacagggatgacacatgaattcagtttgcctgactcaaagctctcatccaccatcactctcttttgctatttggaaaacactcctaacatgatgctcacccatgcctcctttcttactcgaaagaaccacggttactgtgtgtgcaggtgcacatatgtgcatgtgggagtgagaggccaagctcagttgttgttctcacatgctgtctaacttgttcgtgaggtagggttccttattggcctagaacttgctaaaatggctagtcttgctggccattgagccagccctagggatcctgtctccccttccctagagctgggattctaagtgcacgccaccatgcctggcataggcttcttcctcctcttccccttcttcagtgggagatgggacttcaagtattctggtttcatttctgttgctgagatttaaaaaaaagatgcaaggagaaggcctattttagctctcaattcctggtagcatcatcatagcaggaacatcaagggatcaggaccgcaaaccaactggtcacatcacaaccacacttaagagcaaaaataaatgtgcttaatattcagtgagctttctctacttcatgtatatctacatgtctacttttagtttcttatagttattagtttcttatagttacttataatttctctacatacatattttctatatatgaacatatatgtctagggttccaaaccaagggctggtgctgcccactttcaggttgagtcttcttacatggattaaggcaatcaaaactatcccccccagacatgtccacatgtcaagctgatctagagagtccctcaatgagactatctttgcagataggttgtgtctggctgacgatcaccatacaaggcaaggcattgctctctaagcatctgtccaaacccccatggctctttttttttttttacattttgtatttattttgttttatgtgtatgaggatttgattgcatgtatgactatgtaccacacgtgtgactagtgcccttggaggccatataacagtgccaggtctctgaaactggatctttggatggttgaagatgccttgtgggtgttgggatctgaacccaggtgctctgtaagagcagcaaggactcgtaacctctgatgcatctctagcccaccaccatcccctggtacttttgttatgtcacatgtcatgcttttccttctgtttttacataaaatggcataaagaggaggccaggccagtctctctgaggcaatcctttgcacatttgaaaaccctctgtagaagatcatagcagcttctccatagaccgaatccaatgtggctgacatgaaaggacaatgtcctacaaaggcaggctgggcagcttgcagctctgtcgaggtgcacatctcctgtgagtcagcagaagccaacagacaatgatgtgtttgctcttcgaaccatgagtcagccctgataaatggccagctttcgtctagtccctgacgtcttaacagaatattaattgccctgttgcttcccgttccacacagctgggtgggattgctaccagccacagtgctgaatgcttacatatttcagcccagcccagaaaggtttcctgtggtgggtgaaatgacaacatgcacaaaggtcaaattccagatgtgggagtctgaatttctctcggctcaggaaaacattgccttgttatgatctcagaagattttcagtacagatttaaggccagcatctctggaaagaggcaaacgtctctaacctagagggtgcctagagggtgcatttatccaaggctttgagaccatctcttgaattcccaagctaagggagcaggggaattgctcaggcatttctgcatgagggggctggctctacacgttgctgcttagacttggacttggaaggcatttggggatgaggagttagttctggattaataccttggctgaacgaagtgccagaaaacggtgggaagagtacacagctgtgtggtggggaatttcctgtttgtgcagtaattcatctgtctattctttctttctttatccatttaatcatgcatgtgtgcatgcatgcatagaatgcatgtttgcatgtgtggtgtgcattcatatgtatgcatgtttacatgtgtgtgctcaagagcatgtgggggttgatgtcaggagtcattctcattcactcctccactttatactttgagtcagggtctctcagtcaaacccagagctcaccattacggctaggttcccgggccggtttgctcagggaactccatttttgccttcttgctggctgctacattcacctgacatttatgtgggttctggccatctgaacttctagtgtcatagtcgggtggtaagtgctttaactagtgaccctcatctcttcaggcccccacttattcttttgtaaaaattcatgtcacttttgcaaaattgactatcagtatattcagaagtgataagaaaacgtagcttaatttttctttattaactgatatcatgatcctgctgagtttctacctgtagactctggggtgggaattaaattttagcctcactgtgtaaacataaccaaattaatctaggcaaatactgtctagttttatctttcagaatccctcttcttatctgctccaatgcaaactggcctctgagtatacagcattggtagtggatgaaatccatcaaaaatgtgtgttgcagagtcactgtagcagaatggctgatgttgtctgcttccttcttgggaactgccaaaggatgcaaaacaactgatgtgtagttgtggtcaccattggagcccatggctcagccactgagacccaggtcaatgtctgtgtgtgtagtgaagtgcagtgggctggctttggcctcactcaagatgctccccttgtacttcctccaggggaatttagctctcagatgagatgtgtcagtgaacttctctacataatgtcgaataacaaatgtcccctgcttgtcggtggttaagataagcaacattcagttcacaaatgatttcctgtaaaaactaaggcattgtgtctggtagtcttccgtggtcacactagctcccaggtcttcccttgcaacacaaaagctgtcctagacattgtataaataaataaccatgactacattccaataaaactttatttgtggatattggaatttgatgttgcttgttttcatgtattatgaaatactactttaaaaatactctatttctttggtttgtgtttgtgtatatgaacgtatgtaagtcagaagacaacctgctgggtcagtgttcttcctccactacctggggattgaagccaggttgtcaaggttagcagcacatgcccgcctcacctgctgggccatcctgttggccctttcccatttttcttttgttgttccggtgttttgaggtgggggtcttgctttgtagcttatgctggccttgaactctcagaaatcctcttgccaacacctcccaagtgctgtggttacaggtatgtgccaccatgtccaggccagcttgaaccctgatttagttccgattctgttctgggatgcctgtggctgctttgggcagtgagccaggcagctctgttcattttgagtgggtacacacacgggtctggcggctggttcaccattagctaacctagaataggctcggctggaatgcctgtgaccagtgagctctgctcccaaacctgacatcaggctaacccaagaatgttcgaggcatggcagaggcacacatgtgcaagcccattaaaagcttctgttcaattctgtctgttaatatcccacagccaaagcaaggaactaagctaaagccagagaagggtggagcaggaggcactgccaaggtacttggcaaacagcaatgtgctggggccattagcacaaccagagaacttaagccaggaagaatcttaagactcatcctatttgggatcccttcttatataaatgggtggatgcataggtatgtgaaacaagtgtgattcgagaagagagcatgtgccaaggctcggaggcatggtgaagcttgctgcttctggctgttgcaagtgtagagatggaaggggagcagcaaaaatcaggctgacttcagagaaaactggcacttcttggtagggtatcagatgcagtggaaagggccatgttcaaagaagcagcctgtgggaaaggaagcaggcaataagggctcaggttttgacttcagcagcctgcggtgctgtggtcggatgtgcagggcaacagacctcttgcctccatctttgttttcagtgcagggggcatgacagatgaggcagggaacacagaacctgaggagttcaggtctggtttggtgattttagagtgggagaatcgggaatctttatttcctggtgtaatgtgagccggctcatgtgtttcctttgcccttgaatcaacattgaactatttgagagtgtggagggggctaagctttaaagaggacttaatgctatttttaaaatttttatttcaaagtgtgtgtgtgtgtgtgtgtgtgtgtgtgtgtgtgtgaatctgatgcctgcagaggcctgaggcatcagatcccctggaactggagttacaggcaattgtggccacctgacatgggtgctgggaactaaactctggtcctttgctaaagcatcaagcctcagtcttccaggtagctggattagccctctctccagcctgaaagctaagcctttgccttgacttcaagcagcaggcagttctcccatcctctgactctccattcaaactgggtaatgggaaaagtggaggacaatgtgctctggattctgactggagtccttggagttatggggaatattgctttgtcttgtgaaggctggatgtcccccaagagtccagtggtttggagtccagtcatgcatatatatgagactttgagttaggactttggggtctgggttatgaaacactatgaacaggtttccttgttaaccaatggcaagataggaaaagagatgtttgttataggaattacagactcagttctctcctcataattacagatgcacccttgaagcatgctacagaacacacaatgagacccggcaattcaatacgaaaatcaaaacatatttggaatgaagcaccagaggtttcaaacaggggatctcaaaggtttgaaaatgaatcaaaaaggccccatgtttgtgtctttaattgtgaatagtttccccttcttgtccctaagtcctaatgtcccaagccccttgattctttggttaaaatcaatgatgtaattaggagggactgtttagaagctcaatcacccccatccccatgatttcagatgacactagctttcctgggaaccagacttgaacataatagaatagctctgcattttgcgtttctatctcaatgctctcccctttccatcatctaattgaaaaagaagctttcatcatcctgatgtttcatgttgactagacattttgtctctatcatttcccctaatttattcacattataccaacatgacaagaagaataggtctggaaggaactggacttggaactaactggatatggtagccgcacatttaactggatatggtagccgcacattagccccagcagtgggtcacactaagtaggacgctcttgacactggggagtcagcctctatggtcttttgtctcaaaaaagccaaaaccaaactaaatcaaaccaaagccaacaacttctccacgacatctgcatacttattgtctgtcttcccattagaatgaaagcttttgatggtatagattttgttttgctaattgagatatgcttagttcttagacagggtgcttattaaatgttccctggaataataaaagttatacgccaatacagtaggttttactttggtgttgtgtttttttttttttttttaaacctgcattgagtattgccttctactgagttcagctaccttttcaaattgtaactcagaagaactagtcccacattgtcagccctggctactctagtccatgttctcatcttctcccactcactattactccatctaatttttatcattactattctctaccagtcactgatctgggcagaaggagacagactgaatatagcacgcatgtgtgtctgcttccatggggtccatgccatgtctatttgactcatgtgaactattgtctagttccccatactctacatcttgatagaatccactggctaccacagtggccttggcaaagactgatcccagaattcatggttttctctactgttggaaggtgattgctaactgctgtgcttggttattccatgacaggaagatgagaccaaatttggaccaagatggtctcagagtaggcaaccgaacagcaagatatgcctggcaccaactcatggcctcacccctaacacatgctcatttgcttgaaaatgacaggtaggggtctgtggtgccacacaactgctcttcctaaggactagagttcaattcccagtactcatatcagatggctcacaactgcttgtaaccccagctccaggggatctggtgccatcttctggactccttggtcacctgactctaatgtgcatgcccacatgcagttacacacacacacacacacacacacacacacacacacacttaaaaataataaaataaatagactggtggatagtccaggtatggtggtacatggctttaatcttaacacttgggaggtgaaggctggaggatcagatcaacatcatccttgattatataatgaattctaagtaaacatgggttttatgagagcctgacacaaaaatgaacagaattacagggggatttaactaggagttcccacccagaagcatggaatgagccacaaacagcagcctctactcatgaccaaaaggcaggccttggtgactaagtgggccacagacactgtcctaaacttagctttgctgccagtgggcatggctgggttttaacctgaaacaccagtgaattcactatcaactccattaaagcattaaataaaaccacccaagcagtccaggtaaatgtaaaccatgaagccaaatcttatccctaagatatccaaccaccaccacatgagcttccaacttaaaaataaataaaagaattctctatatttggagtcatttcattatcctaaatagtcagcttccttccttccttccttccttccttccttccttccttccttccttccttcctccctccctttcttccttccttccgccctccctcctttcttttttaaaggaaatactaccttaaagataaagaaattattcttattcctcagcatttcctcagaggcagactctttggaattatcagatgcatagaatggatactgagctgtactgaagatggaacccagggcttcacacattagattcaccaatgagccatatccctagccttccttttattttattttagattactttttattttgatgcagaagctcactaagttgcccaggctggccttgaacttggaatcttcctgcctcagtcttccaggtagctggattagaagagtatgtgttaccaggtctggcttcaacttaaaacaaccaaaaccaagagaattgcccacctgagaataccttttgaggctgcaatactcatatgaatgacaaagttgtagatgagaggtggcagagacaggacactcccagcccaggcttcccagcacttccttctatgggcactggccactgtcactgcccctcccctttcttctttctccttatgattgcctgcaaataagatattaaaggctgagtgaagattctggaatttagggtgggctggatgggctgctccttgaaagtgaccaaggctcttgatatttgaagtatttaccagatctcttgagagagcagattaatgatggaaggagagataaattttcccttgagtcctggcctataaatttccttccatacaatcagagatcttcctcccacgtgtcacatcacagtcacttgaacatccttgtctgtgcgccaaggtcctgttactgtgttcttccttctcatttgctatgtctaaagtatgtggcccttgcagcacagagctgagctgaacaccactgtgcttctgaatcttagggttaagacgttggtgtctgccagtgagcaacctctgaacagtcgagtatcagttcacagtggggctgtgtcccagaaaccctggtgtaaggtgacaatatcacttaagtaacaagtgcatgcagcgtacttcctctgctagacactctgcccgtggagtagagtattgtctgtccttggaattgcctggctgcctagatcaagactcgaaattcaaagtacaaaatcacattgcttttgttttgtggtaaagttgagaaatcattcagtctggcctgggaagataggttagtgggtaagaacactctctgtgcaagcatgaggacctgagttcagatccctagcatgcatgtacaaactggccatgaccatgtgtatcagtaaccccagggaaggtgtgtggggtgtacagtcaaaaggaacactggggcttaagggccagcagctgaaccaaaaagtagccagctccaggttcagcaagatgtctgtctcaaggtagtaagatggagagtgatagtgcaggacacatctttctctggcacacctgaacacacaggtgaatgttcacacatacagcacacacacacaggcacgcgcgcgcgcgcgcgcgcgcgcacacacacacacacacatcgagcacaaaggcaggcacacacgcacactgttcagttgagttatcctaagttggggactccatataacagggaacaggatctatgatggaagtagttctagaagaatggcagcttttccatgtactttcagagctgctgtttccttgggtttgttgagcttttgttcttttttcactgacggctgagatttctcatatagactctgaaagcagtgactttgttgagcatttaggaatttggcttcatgggtggtttttgaatcatggcagtgtttaatcttaattgagtgtcctttccttttgagggtctctccattctgtgtatgtcaggatgccaaagagttcgcatatgggtttgtttggaccctttagtctgtggggaaccagtgcatcaagaatggcttgggcttttttgtttatcttgaaggggatattttgctctctccttatgatgagtactgtgaaaaaagcaacttgtgtagaaaaaagtttatttcatcttgtacttctaggtcgttatccatccctgagggaagttagggcaggaactcaaggaaatcaaggcaggatcttgaagcagaaaccacagaagaacactgttcaatgcttcctcccaggcttacatagctacctttcttatataactagagcccacctgcctaggtatgataccatccactctgggcttggccctcctacatcaattagcaatcaagaaaatcacacaaacaaaccagcaggctcgtgatggacgcaattcttccactgagattatttctccacacatctgccaagtggacaaccaagattagctgtccttccgctcccaagaagagacctctgggtagtctgtatactgtctaggactgctcatgtttaggggatttctctgtgaaccccccaaatatgccagctgctttaagcacataaactctcaacttgaaccagggtaggattttctcagttgcttctagacagtttttgaggattgaggggtttttgtttttagtgatttcctgagcttccatatcctggctttattgaatcaaaagaacttcatgggaaaacagaatgtttgaaatattcattcacaacagtgctacatgagtgagctcagcggcagatgccggggtctgtggctgtgagaacacaattaaaattttaacttgtttgtgaaccgttcttttctgtacagctcgatttcaagggcatgggggaatgaagacagtgcttatgtgagctcctcctgctgtaagctcagtgttgaaaatgtaccccattcctttgactaactcaaatacactggcctggtggatttggagagctgttgaaaccattaagattgttctacaaatagatcttcagaatattgagtacaaggattctcaaaattccctgagtgtgaatcaaccaatgtgttagttaaaaatgtagacatgtagccactgccagtgaatgttgagttattatcctctgcttggatcaacagaggagtactctctgtgtgttttggtgaacatataaatgtatttctattaagctctgagaagaaaagtttctgcatcttaaagtagacagatagtcagcatttgtaaataccatccttccaaaaaagtgtccccaagtgatactgtcatcacacagcttcatgttaccagtggagaaactctgctgtcacgcttggtggcaactgcccttactcactgagtcatcttgatagcccaaggaagatccatctagatcctcctcctcctcctccccctcctcctcttcctcctcctcctcttcctcctcatccttcttcatcctcttcttccccctcctccttctcctcttctttgttttttttttgttttgttttgttttgttttgagacaggatttctccatgtaacagttctagctgttctggaactcactttatagaccaggctggcctcaaactcacagagctcttcctgcctctgcctcccaagtactgggattaaaggtgtgtgtcaccaccacccatcccatttttttcttttttaagttttatttattttttatctgtgggtgttttacctacatcatgtatgtggaccacatgcatatctggttcccacagaggccaaaagaaggtgtcagaccttctaagactggagttgcagacagctgtgtgctgctatgtaggctctgggaattgaaccctggtcattgctcttaacagctgagacatctctccagttcctgggaagaatcatcttacttgtggcttgaaccttctctgacagggatcctggactgaatagatgaagaaaatgagctgggtagaagcaggcattggtttctgtctgtttcctgattggggggtatgatatgaccaactgcttcaagccctggttgccttgaattccgtgtcaggatggactgaacccttgaactatgaaccagattaaacaagttctcccctaaattgctttaccacctgggagtggcactatttgaaaggattaggaggtgtggctttgttggagtaggtgtgtccttgttagaggaagtatatcactaggggtgggattgaaggtttcatgggcccaagccaggcccagagtcgctctctctttgaatcctgatgtaaaactctcagctacctacctctccagcaccatgtctgtctgtatgctgccatgcttcccatcatgatatcagtggactgaatctctgaattaaatgctttcctttacaagagttgccatggtcacggtgtctcttcacagcaatagaacacgagctaagacaaagagtagtttattccagtaacaggaaaataaatgagaacaccagccttggctacatttttaattcaacaactgcataggcaacaagagaccatgtctaaaaaacaaaagcaaaagcaaaacacaactgaagtaagctgtggtattaaaagacaaaaggtttgctttataggctgtggctggaaggagcaggaggggctgctggggtcttggtgatgcctttgccttgttatgagtacaatttagcggtgtgattgcttataccaagacacagtgacctttgtaaaaatcacagggcaacaaaggaaatgggtttcctcagggatcatcagctctgtcccaggaaggttcaagtctttcagccctttgtggccactcaggagacagtcaggcagatctctctaagttctaggtcaccttcatctacataacaagttccaggccagtcagggctacacggggctccccctaaaaaatgggggatgggtggtctaattttaaaaattattttaagtagcatattcccaggctactttcttcagattacctcaagaaatttttttgttttgtttttgaaatgggacttgagactttaactgtttgacaaacacatgatggctgggatgtcatggccttacaaacgctctgtgggaaatacgatgttaacggttgtttttaaattttttaacatttgtttgttcttgtgtatatgtaagcatgtacatgtgtgtagccatacaccatggcacaactcatggcagtgagaggacgatctgctgacattggttctctccttctattatgagggttctggagattgagtgctagtcccaaggctcgggaagagtgtctttacctctgatcacccggactgagatttttcaatcttataaacttcatcataaaaaaggtatcaagtaaataaaacacatcacaccaaaattgagatgcaaggttgctggagcgcacaggacgtctatacagttagaaccggcacccagagcagcagctctgaagaccacggcaatttttacactttcggtgtcacaactatttatgcactttcctccacccaaaacaaaaaatccatgacagaagggtgtttttttttcttcttctttttttttttttttttggcatttgtcaacttttcaaaacaatttgctcagttgctttgccactgtggctatttttggtcactttggatatggtttctgagcctctaacctttcatcttccgagagtgactcaatattggatgcagccacagcccacacttgctatggaaaggacagccaagtgaaaactagaccatttggtggagagggaaaagcccagagtgctgaagtctagaaccttctctgggaacagggcttatcatttctggcaaagtccgggttcatttattcagacatgggtgacggagtgtgtctgtcatttggcagagtttctgtaaaaactaggttaaggaccaaatcaaaactgaggaggaagcagacagtgcaaggaactgtcagctcttgctgactaaaagccaccccctgtctctgcggtcaggtctgagccagatttcttttcactggtgaggggaagcaccaggtgaccatgcaggcccagtctaaggggaatcaagagcatgggagaaaatctccctccgtgctgtttagagcttgctttatccaccccagtgctgagaaggaaaacattctcagacgccaagagggaacgtgttcttagctagttaaaaaaacaaaaacaaaaaactcagctctcagaaagagtagtctccttgagatacagaggggtggacagtgtcaccagatgtcattgtgcaggggatatgattaccagcgtggctgcactgatggtaaagtgctattgagggccaaggtggctctgtctgggtgggatgaaggcctcccccagttctacacctttataattttttggcttttctcatccaggctgtcgttttcagctataaaccatgcagacgctttgtcattaggttaatttttgatcccatgggtcctaaatgtcttcggagtgacacatggtcccatacgcttatccgctcactctcttgctcagtgagcaaccatccacagaatgtattctgtgttccaggagctgtggctgccagtgagagactccctccttggcttaaaagaagttcacagtctggtggggatggtcagctcctacatccataaccatgctgcatcacagagccatgagtctgtgacagagcaaagctgccatgaggaggtggaggacacttccttaagaggcggattttgagcttagtgatgggaaaatgaaagtcagctgggtgggaggggggtagggatgggggacagctggagagaaatagcatagcttgtgccggtagcagaggagaaggcagtgtgagcctgggtggaaagcagactcagaaaggctgcttgggctgaggggggtggggctcagcttgactctgtaagtcaaaggttctcatcccatgagtctcaaattaccagggtgtgaacaaataatgtgtaactaataataaactattaggttcctaatggcttccctcctagaaaaaaaatccacattagagcagctcgaaggtcacccctgtaatgtggtggctctcccccactggcattccatatgctttcttgaggaaaaaggggaagagctagggctagaagccagttcttgaggcttctctctgctccccttctctaagtagcaagttacagctatggaatttacaaactgccattgctccttattccacgcagaagctgtcatcccatcgaatctaggcatatgctgggatcgacagtgcgcctatcagtgtgtgcatctctcatcttgctggccccagaaggcctgcagctgtgttgataggaagcagtgtgacggccaatggtgtgggcccactgggcagcattcagacattcggtgtataagaaaatctcaggtacatattctaggaactagaccagactagcttcaaacttgtggttatccttctggctcattctcctaagtgctgtgtttatagatatgagctaccatacctagggtagctctagttcaagtaaattatatgcttgttgtagttggttgtgtaatatggcatcatatagtgactacatcttaaaacatacccacccaacgtgatggcaagtacctgtaatcccagcacttgggaggtggaaacagggggaacagaaataaatccaaggccatcctcaactacaaatcaagttcaagcatgagagtctgtctcagagacaagcaatcagacaaacccccaaaacagaataaataagtaaataaaataaaagcctactccaaaatagaaattttaaacagataaaagtgaaatgaaaacatttagaataaatcctagggtataactcagtgggaaaacatgtgcaaagcaagaaagatgcagcaccaaaaaccaaaaccgaaacataaggggaatccatttacagtgattttcatcttggtttaatctttcaggcaaagcaagtgtagaagtattaagatttattagggagaaatggggaagaactcccagagtaggaggagctggaagggaagagcnnnnnnnnnnngcggcctcattttagttatttatattgaaccatgtcttgatccttttccaaactatttcagttctttattctagtggctgtcgtggctgggaaagatctttaaagtgatatagctccaaatggaagctggagtcctataccaagaaatcatgctctcaatgctacctcataattgtgcatgcatgtatatggtttatgtgtgtgtgcatacatgaatgctggtgcacatgcccacgttgtatgtttgcagaggctggaggaggatatcaggtgtcttttctctgtcattctttcttgagacagggtctctcactgaacccagaatacctcatttttcagctgtactggacaccagcaaacgccaatggtccttctggctctgtgtgcacacctactcaccacagagctgggaatctgaactaagccttcatgtttgcacagcaagcactcttactcactgagctatctgtctccccaggctctacaaaagtttgtgatgaaactctgggtctggagatggagagatgccttagtggctaaagcccctcactacataagaatccagtaaatgctggataggcatggcagcccacctgtaattccagtctcagaaggaggaaatttgctgcccagactaagctgcccagagactcttgccagatcagtgggcttaagactgatcccctatatcatatcagccttgagcctctacatgcacatatacacatatgcatgcacactgtcctagttagcacctactgtcaacagcccagagtcatatgagggagtctcagttgggttattgtccagatcggattgtcctgtatccatgtctgtgaggaactcttttggtttctgactgatgtgggattctcagcctgccctgggtggtactgtctctaggcaggtggtccttgctgtataagaaagcaggctgagcaagacacggaaaggaagtcagtaagctgcactgctccgtggtttctgtctcagttcctactagagttcctgccctgatttcatggactgtgagctggaagtgtgaaccaaataaaccccttctttcccaagttgctttcagtcatggtatttgtcacagcaacagagaagaaactaggcacacacatgcaagactacacacaccaccacactatccatacatgcacatgaaaaaggaaaaagaagttttagttaagtatcttttattatcagtcagttgtcctcatgaattcattgagaggtatatacatttttcatagtattaaaaaatagattcactaatccactgaacctcagagtaaaagaaattaaaataggtcaatcagtttagtgtgccaaaattttaaagggttttgatagatatgtttgtgcactcagctcattgttggcagtaaagtcacaaaacgccggatatgtttccaaaggtctgttttccaatttcttttcggctagagtttcctatgaaaagcagtttgttttctcactcactgtaaattgctaagttgaccttgaagggagtgtagcaaacatttttttttcaaaaataactgcaaggtagccaccaaaactaccaatggaggaaaaggacagcatatgcaaagtgtttttatttacacgtttgtttttgtaagagagaagacaagactttggcagtttgaaaattggcctggttggatgttggagtgagtgggaagcccaggattaattcctagctttccagcttggacaccttcttgaatgatggtgtcaccaaacgaggcagacagcagaagtagaccagagtggatacagagaggagatagggagaaaagtagaagcctggagctgttgctaccttcaattgccatcaggaaaccccactgttgctccatgctcatatgttaaaaccaaacacccttagctttatttgtttgccctttctttacttctagctctgtctgtgtctacaccaactcttgatctcttaaggctcaaagctttggggtaatgcacgatgcacctttgagtgactaagccccttcaaatgacttgcttccttctgtccccagcccatgcacatgtgtgcagctgaactcttcagtgtgtagaaagaggttgatgtcgggatgtcttcctccgttgcttctccacattattactattattattttatgttttgagacagggtttctctgtgtagttttgaaggcttacctggaacttgctctgtagaccaggctgtcttcgaactcacagagatccgcctgcctctgcccccttccccctcgagtactgcgattaaaggcatgtgccaccatccagctccatatcattttttggtgacagggtctctcgctggattttgaacttatgtttaatttaaattgaccacagggatggagagatggttcagggtgctgcaccatggaggactggactgcccatattggtcagctcacaactgtctccaggggatcagacatcctcttccacattccaaaggcaatgcactcgtgtgcacatatgtacacaaagacacacacacacacacacacacacacacacacacacacacgtaattaaaacataataaaaatgtctttaaactggttggccagtaagcccctgggatcagtgtatctttgtcttccagcactgagattaaagatatatcccaccatgttgacttttatattataggtatgggggataggaactcagttgtccacatactttacccacggagatatctccccagcccctctagatgtatttattgagttctttctatgcaccaggtactgacataggccttgaggagatgagcgtgaggaagatagagtctctgttctcatggggtttatattctggccagggagtataataaatggatacatacaactgttaataaaacagcagagactgatttggggataaataagagagttatccacaactggtggcctctagaaaagtgctctgaggaggagacatctggaagtccacctgctctcaagggaatgggctttgcaagcaagaagctccatgctctccaagagctctcagcgaggcttgctggtggcagcagtgggcagcagtcacttagtgtcctcgcttcttctgatccccaggctccacaagcacagatctggtctgactcagtgcccttcagcctccccactatgacactttaccccagctctttcgagtgtgagtatttgattcgttgtaccttcacaaagagccttcagagttggggcacaccaggctgatctccgaaggttacaaatacacaaagcacctcatctggggacctgatggggaacagtgtctgcactctcctatattgctgtggcaccaaataagtcccaatccagcagcttcaacctaaagtatctgggatgaattctctctattctagaagccaatatctaccctgggacttcctgcagagcaacatctctttctggaagctctggaggagaatctccttccttgtctgttcccagcttcaaggagctggctgtgtttattagattgtggcctcctctgccatcttcaaagccagcagagtaggttctggcaatttccctctggctttaagcttcactcttgtttcttgccatcacttataatgctgcttatgatgaattacattgtgcctgcctgatgactcaggaatggaatatctcctatttcatggatctgatagatgtccttacctcatacattagatatacagcgttattactgtatgttactcttagtattaaggattacaatgtagctttctttattctgcttaccacacctgggttctttgatgtactgggttttattagatatttgtagctcgtgggggctcccttgaaatggaaaagtcacacaggccaagaggtgacccaccacgtgactctcactgggaggttgctttcactctacaaagatggtgaaggcatcaatgcccacctgcagggggaggactcccagtgtttcctgcaagcacagctgagtgtggggcagtgggaacagcccttcaattcttggtagctcgggaacagcaggggatgtttctgtatatcacgagatgacctggaaggcacctcccatccggtgtgtttatgatcttcctgtttggagagatgctttccaagaggaaatctatggctacagtagatgttaatggagagagtcacatgaaatactaaattataactttgtagaagaattattaacctttcttagtagacacaccatgtctgatgtacacttgaaatgggtaggcaaagaggttcgagattttgtatttcaatctttgtattagccagcttgctgacactataataaaatacctgagataattataaatataaaaaggttcttgttgctcacagttttagagtttttagttcaaaatcaggagattctgttgctttcaacttttcatgggtgtgccagaaaaaaaaagtcacatggggaggtagaagagcaaactggctgccttgtggtcaggaaacaaaaggggaaaagagggaggctgatcttcccacaatcttcttctgtaggacgcactgcttaaagtaagcactggagaaaccaggattatcaatcccatgggcctattttcttcaatgaaggaaatgaataatgcctggtcaactggaatgccagagcgaaggtgatcaagcaacctggtgatcctttgctattctgagtccccccaatatcctgagcattgtttaggccctaaacctgaactttgtctctcagtaaacagaactcatccctatgaaagaggccacaggtactttgtatcctccatggacagaatttgtccttacgtttatcacagacctaaacctgtgggtctttacccctttggaggagtgaatggtcctttcacaggggacacatatcagatatcccacatatcagatatttacattatgatttatagtagtagcaaaattacaattatgaagcagcaatgaaaataattttatgggggggtcaccacaacatggggaacttattaaagggtcacagcattaggaaggttgagaaccactgctctaggtcctgccctgagcactgtccatcagccaatagaactcattcttattgtgaaggtcacaggtgctctgctaccttgctagagagtttctatgtagctaaatatttgttttgatacctgccatgtggaaacacttgaatgtgaaagaagaataaaccacgaggtcactctctgtaagattttgacccaatatctgcaacgatagtactcacttgagttttcatttttcaccttgcacaaattgcccccttgcaggctgtgaggcttgcagggttcccaacactcttcaacatatctagtgatttaaggacttctcactcgggtttgtttttttaaggctcaacctcctctcaacagtaacatcaggggaaccatgacgtacgttctcagaaagaggactgtcttcatttgtagtttggaaaatgtagttgaatctgttttcctggcagttgtaattttgtctgaatcattagagtgctacaaacatccctagtctgtagagctaaaatcaagcaaaacttattttcagaccctccagataagcaaattggtgcctggtaataaatttactttgctgggagaaaaggcgcaacaaggaaatgctgaggataacgacatccagtgtatcgaacgcgagtgtagtttgggcaccgtggtaagcattttgcttatgtcttgaaataaaaacaatgaagaaagtagtgttgtctctcagggtatgtgcagggttctttccacaagcccctaaagatgaccaaatctgcagatgcccaattccttgttataaaatattgtgtgtttgcaaataacctacacatcctcctgtatagtaccaatggtgtccagattgtttataatatctaatacaatggatatgctctgtgagcaactgttacatagtattgttcagagactagtgacaaggaaaattctctgcatgtacagtgcaggtgtaattcttttttcctgcatattttcactgggtggatgttcgcatctgtggaatgtgatcttcagacatggaacaatgtgtttatttcctctttaccttttatataaaagggtactaattaggcactctaaaatatatgttcctaaagactaagttggacacacacacacatacacacacacaaataataaataaataaataaataaataaataaataaacaaataaacacttttaaatcaagggctagtggggtggattgtgtgcaaatgtgcttaccatgcaaggtgacccgagtttgatctctggattccacataaagatacaaggagagaatcaactccgaaaaattgtcctctggccatatgaattccatgacacaaacaccctcattcacatgtcataaatacacaataataataaataagttggtatctgtattaactcactgcttcccagctatgcttcaaccccaagcttttcctcctcctggcatcatgggggtggggcaggaaggtgggttttgatggagaagatggctgggtgatcttctagaaggatgggtgtcctcaaactacaaagaaatgagtttctttcccagaattttgatccctgggctgtgagttctggctttggtatgtatcacaaagacttgctagtgactgtggtctgtcccattccagaaaatggctcaccacctgctaatcaaacataagctaagggtcccttttttctttctcatcagtaagttcgactgccagaactggactcttacgtcttggtctatttgggttggtaggaaatactacaaactgggtagattataaacgacaaacatttttttctcatagttctgacatctagatgctcatgatcaaagtggcagcaccttcatgaatacatctggggaggattactttggagtttgtttgtggtgttacaactatcatgcttggattagtttttaacacaaaaccttggggtggtgcataaacaatgggctgtaagtctgtccatcccaatgactgacattctctgtaaagtatattggttctatctctgtctactaaaaggccacagctccctccactttcaatcctgctagcccatagccccatttattttttaagtattttatttatttttattttattaccagtatgaatcttttgcctgcacagatgtatgaatgccacacacatgtctgatgccagggtagggctgaagcggatgttggttcccctcttgagcccccacatggggactgggatacaaacttaggtcctctgaaagtgcagcaagtgctcttaatcacagatccatctttccagtccacaatgtgatcttttaagaacataaatcagcagggtagatacgtccaatatctaggtgcaatagtggtgtgactgttataggggtaacaaaccactttctcgttaggttcaagggctgctctacagaaggaaacatattcctggtactgtaaacatggccaaaatccaaagtaggggtgctccaagaccctggggtgaacctactactattattttgctaaatggacacagtctcaatctgccctcgtgtcattatacccatgggttaatgcagctctcagtcctcatcagagaagtttttttttatttgaattagaaacatgattgttttacatgtcaattccagttctctctccctcccctccttccctgctccccaactaacaccctacctatcccacacccttctgctctccagggagggtgaggccttccatagggggtggtcttcagagtctgtcatatcctttgggataggcctaggcccatcctgtgtgtctaggctcagggaatatccttctatgtgggatggtctcccaaagtccattcttatgctagggataaatactgatctactacaaggggccacatagatttccgaggtctcctcactgacatccacgatagtggggtctggatcagtctcattctggtttcccagctatcagtctggggaccaagagctctcccttgttcaggtcggctgtttctgtgggtttcacctgtctggtctggacccttttgctcatcacttctccttctctggattatatatagttcatttcagtgcttagctgtggttgtctccttctacttccaccagctgctggatgaaggctataggatgggatataagttagtcttcaatctcatttcaggggagggcatttaaagtagcctctcctctgttgcttagatgattagttggtgccatctttgtagatctccagacattaccctagtgcctgaattccatcagagaagtttttatgaaatgcacaactggtcaaatagcagagaataggtgtccgtggagtgctcagccacaggtgggactctataacatatatatacccaaaagctcagggaacatttcgggagaggagggagcaagattgtaagagtccatggtcacaaaggaccaagtgacttctggacatgacaggacccctgtactcatgaactcatggttgctggggttccttgcatatgagctacacaaggtcaagtcagtcaaaattccagcatgtcgtgggaagggttcatgagccacccctaactaaggagcttatggacagttgatgacttccaggggaaggaaagtcatttttctttagtgggtgtggcccctgggaagcctctcacacaaatcaagttattaagttaaaataaaaacacaaagtcggggtatagggaggtgaggatgtatctgggatgagttaagtgggggtattgggagtgaatatgatgaaaatatattgtatgaagttctcaaaaatgaaaatatttatttacaaaaatgaagacatgaatcagaaatgtctcttcccccatttttgattttcatcggcagcttcacatcaccctttaaaacaagatcccagtccctcagtgcaggtttcaagaccccagcacagtggatctagtctcctctaaacctgtactgcactccacctcccttcccactgatgatgacgatgacgacaacccgtgttccctctgctggggtcactttacctccttccctaaacaccagtagttcccaaagaggcctcaggcaggcatacctctgcactcaaacactatcatcatcctttgacttttaaatgttacagctattgtcttttatcattttattgggaacttggtttgctttggttcatctccccacttcagggctggcccctcatctactcaagtcctcagagcttcatagagtacctgataaatgaggtatttactaaatatttaaattcattggctatgtaagtaagtggtaatgtgtgttgcaatgaatttttcagtgttattttgtaattacatttctcccttccttctcctctctccaaatcctcccatttatccttctctgctctcctttaaatctatggtttctttatacatcagttgttattgcatacatatatgtatttgtatatacatgcatattattaaatacaacctgttgagtccgtgttaaatacaacctgttgagtccatgcaacattacttgtgtgtatgttttcaggaatgactgtttggtactggacagcccattcatgtgctctggggagaactctcctgctcccagctttactcagttgcttgtagccctttgtttagagttgaggcctttggggcttttccgcatccagtttgacaattttgttggtgtcttccttattcagctcacatttggggggtcacgttggtgggacttaatgggtatagcttctgatgttaataggagatgtaatcttgtagcaaatgccctgatcctcagtctttccacctctgcttccacaacgtccccgagttttaaggcaaccaacagtcagtcctgcccagctctgatacttacaaaccacaccaacagccagcatagcatcacaagactatggaaggagcagtagcataccatgctgataaagcacagctctctagttggacctaagacctgctcggcaaaaggagaccatagctggtactggaaacctcactaactactcagtacttctgaaatcatggttactagaagagaatctactaggaatctactattttacaaatcagcacaacccctatcaacaatctacagacatttgctcctaacccacagataagtgtaacctttacccctcatcaaggaaacctctctttacaacagacaaagatggctatagaaaatgcaacctaccggagtcctggagcccagtctcaatgaattcatcaatattaactttttaacattcatttagtgtgtgtgtgtgtgtgtgtgtgtgtgtggactagaagacaacttgcaggaatcaattctcttcctccaccctgtgggtctcaggaatcaatctcaggttgttaggtgggaaatgtccttacttagctgctgagctcactttagtgtatccgtaagcacaagtatacatgctgtatactaccatagtttgaaaatgttcccaaaagccatgtgttagatacatagcccccaatgcaacaatgctggtagatgctagctttgtgagggctccatctgcctgatggatcggtgccaattataaaagggcttgaggctaccagttcagtcaccttgcttcctctctttgcctttctgtcatgggatgacacagcaaaaaggccctcctggatcctgattcctgacctcagacttctccacctcagaaagatgagacaataaatctctgttctctataaattacccagtgtcaggtgctctgttatagcaacataaaatggcctcaggcagatacttcagaatgccagatcaacccattaataaccctcttaactctctaaatcagagtatggtctgcagtagcatttgtggcccacaccactgcagcttcatgtccatttggaaacagaatctagagtggtaagaatgattttacttatgaattcttctcacaggtaaaaccatataggcagggggagaaggctgagctggtgtgcaaagagaaaacaggacaggatcacagggaaggaggacagggctttgcagttcctgaccagtgtcttcttttgcccagctcactctcatttgcctggatccagggaaatgtcagctgcctgccctctgagcacaaagccagtgtggcaagggtaccacagtcagtttttcacttgatgaaaacgggctaaccacgggcatgctgcctccgtgttccaagctgctggactccactttcacccagctatgatgaatggctccctcttcactagaacagtgtaaggtctaagacttccaggggaagaaagcagagaaaatatgtgtgagtcaccatctccatggtgtcccctgaaaggaaaggtccctgtgtgatagagaagcaggaactgtggtctagagactctgtgaacgtaaatgatttggttgcaggatctgagctttggggcagcagagtgaatttcctcaggtgatggacactgaagtccatgctcacagtggaagacaaagttagccaaaatgcaatattcccccctgagccaggattttatagcaggctgttccacagttagtggcaatcaatatcaactcagtttaagactatccaatcctgttagtctgacctcattaaacctgatacaaacaagggactacaagctagaggctgtggacaggaatgggagattcatactgtcgtagtcacactgattcaaaagccctttaacagcaaagccatgagactgacgtacgtggacttctcagcagtgcaacaagctgtggggttttcctaacgtgtccatcaaggtgtgaacactgcgagcccagcagaagctgtttctatttgaacaataggtataagcttcacagaggaattacctcagaaaatgctatcccagagtaggctgcttctgtggtgaagctcagaaaacacgtaggtctccagagttttcattctcagaggaacccgcatcatgtgtggaccaccatccctcccaccacctctgtccaggcaggtgatgagggaaagtagatcttgaggacactggagaattgaacagcactttttttctgtgcatagccacagatcacccaataattccacaacaagctctttttatgttaattttttttgagacaggttttctctgtgtagctttggagcctgtcctggagctccatctgtagaccaggctggcctggaactcagagatccacctgactctgcctcctgagtgctagaattaaatgagtgtgccaccagcactcagcaacaaagctctttttaaacttgagatgatactggaataaacatatcaacatgtacttatggagacatgccaatataatcttgaggaagcaggaccctgggagagctatggttttctccagaatcctcatcctgctggaatggtggccaggagttccagcaagagtgagtatgccaacagagtgaggccagaacattgcttcccaaactgaagtatatgcatggaagtgcctgtgcctagagaggccagaagagggtgtcagatcccctggaactggagttacaggcaggaatgatgtgacagacatggacactggtgccggaaactgaccttgggtcctctgcaagagcagcttgtgtttctaaccaataagccatatctccagcatcccccacccctatctgaaatcttgctctttttttttatcatggatatatatatattttaaaattgtaaatgtgtttgaattagctttacattcataccatactacaaacagccttctgagttgttcttcatctagttctgtgtctctgggcttcattgtgtctgcacacacagctttcacacacatcccctcttaccatccattgtggatacacagttcgtttgccatttgcttgctcgatggatgatgaatacagtgttttgttcatataaacaatggagtatgaatttcttttctgtgtttcttaaagtggatctacagggattttgtcgagatatatatctcactagagttctacgggtggaaccaaactgtccccaaagtgatgtttccagtttccatttactataaggccttgagagctccttgcttcatagctccgccaacacttggcattgttagacttaagtctgtagcctatctcatgattttggcacttaacctttttttcttcttagtaagtttgaatatcttttgtggatgtaccggctatttgggctgcttcttcagatgctgccagtgctctcagacagttctaacagtggccctgccttcttcttattgatgtttcgggagtactttatgtgctctcaattgaatttttttcattaccaggatcaaagccaggtcctcatatatacttggcagctgctctcccactgagctgtacccactataatgtacaatgtctgcaaatatccttccagtggtggtccatatatttttactcttttgctggcatcctttcatgaagaaagctttacattttaattaggtaaatttatctagtctttatgttatgattgtatctttaaagatcaatttaagaaatgttccttgtggctggaggggtggctcagcagttaggagcacacactactcttgcagaggacctgggtttggttcccagcaccctgactgacatctgctgtggggctgccagactaggagaattctagggaaaggacatggagggggagatgcaatgtagcctctgaaggaataacaagttcgggcattctctggtaagataaggccatatagaaatacctagattaatagttatgggttaaaaattaagagagagctaaccagtaagaagcctaagcctttgaccaaacagtgtataattaatataagattttgtatacttatttggggctagacggctgcaggatcaggtgggacagaaattccatctacactaactcaatgagatccagcgtcccttctacagtctgcacacaactatactcatgtacatagacatacatacttgtaaaaggagaaagatttatatgatctgaagagaaaccagagtagacatacatacttgtgcacacttactcacagttaaatttttttggggggtgggtgtgttgagacagggtttctctgtgtagctttggagcctatcctggcactcactctggagaccaggctggcctcaaactcacagagatccacctgtctctgcctcctaagtgctgggattaaaccagctaacagttaattttttaatcaagtatttgcctaccagaaattgcaaaaatatttctctgattttttaaaagaaattttgcttccacaattaagtctctaacctggcttcctatcaacatgcatcattgacctaaagggagacaggaggcagcattgtcccgaattcagccttggaacaatttcattcatgttttgggaactctcgctcaacagggactgggggggaggggtgacagacagaccacgaagctcactttctacctgaattgtttgctgggccactagtctttttttttttaaacttatttagaaaacaaaactttcatgaccttaaccaatgtgtctctcacacaaaatacagtgaaaatgcatagaggtcactgtgggaaaatgaggtcactgttattgtgggaaaatgacaaaatggttagtgtgtgctctcatctctctgttctaggctactcacaggaaggaagaggcatcaggagaaggttcttgcctgcgggagtctcccctaggttttcctgttgaagaacgtgggtcattgctgtgtagaaggaaggcagagagacagtggaatgtactctcagagcttggggagaaggaaggagagaagaaaggtacaggcaagtttcgggtcctgagtgtggggagcagagtggagaggctcaattccagccatgtgcagagtgaaagagactcaccctgaggaatggtgctgggaagaaatacaaattcactttagagtgatcttaagtctcaggtatgggtttcacttttgtttctgttactaaattatttgttacatttattgtgaaggggacaggacatacacgtggaggtcacaggacaacctacagagtcagctcttctcccactgtatcggtcccaaggatccaactcaggtcattgaaccttcttgccagctctgttattttgcttttactgcagtaagactgacgagttgaagttctagatattatgctgtgttttttgcttctataatcttattaagtttgtaatctaatggcattccaatgaggtagagaggatgaacatcatttcccatggaattgtaactcagaagagaagcagctgagaagatggtgttgagggtgactgtgcaggctcaaacccagctggtaagcatatatctgtcttcattcaaccattccatggagcctatggagagaagcttccactaatgctgaatgatttttgaaggaattttatatgaataccaatcatctccaaataaagtagctatgtgttactaggatctagtcatcacagggatgctactcagtattagcaggaagtcactgcatcttttgtaatatagtgagatctctttgacttaactcagcatttctcaactttatctttcataattctgatcatacttcaccaggaagggccattgtcacaggcaacaaagtaatttactcacaagttcataggacatagttttgatctttctctgtgttcctagggaaatgaaggtagaatggccatgaatctcaatcatcttgagatttatattttaaaaatataaaatgttgccgggcgttggtggcacacgcctttaatgccagcactcagaggcagaggcaggtggatctctgtgaggccagcctggtctccagagcaagtgtcagttttctgaggaatgtacataatgactgagtaggtcttattttatcattacagacaatgtgcatatatgcatgcgcatgcgtgtgtgtgtgtgtgtgtgtgtgtgtgtgtgtgtgtgcacattagtatgtgctcttatatggccatggatccaccctaaaagtgaacatagcataactttgattgcatgtacgtattgtgttatgtgtgtgtgtgttgtgtctctaggtacacgcatgtgtgtacagatgtatgcatgtgtgtgcatgtggaggctagaggtgaatgtcaggtgccttcccccactactgtccacctttttgatgctgttgtttggtttgtttttcaagacagaattactctgtgtagccctggctatattggaacttgctatgtagaccaggctgtccttgaactcagagatatgcctgcctttgcctctgcctcccaagtgctgggacttaaggtgtgtgcccccaccacccacctcccatctttattttcttaaggcagtctctcactgaagctgaagctcttaattctgttgaacttgctggtcagtcagcttcagggatctgccagtttctgcgcaatcctcaacaacagaggtcacttgtccatgacaccaacccagtctttttatgtaggtggtgcttgcttttgtgacaggttctcatgcttttgtgacaagcacattatcatctagccacctccccagcctcaacacagtttcgtttcttcatggattagggcggtgactaaatacttcaggagcaggaaacacttgaagtcctgacattgtgttagtctgtgttggtcattgttttgcattgctgtgctcaaacacccacaaggaggcaacccaaggctggatgcattcattttggctcacagcttgagggtatatagcccatcatggtgggaaaaggcatggcaacagtagcaagaggtgaagacgtgcttaaagatgatagggggcatttcccgttcaagacaactaatttttttaccaagtcttaattaaattaacaccatcgtggatgcagctgtgttaccagctctaagaggctctgagctgaatctccctttcttcttggttctggtatcagagcaccatcatttcctctgctgaaggtgagtgtgcacaccactacaaaaatgtgtcaagtcaggtcatagtccagcataatagcaacaaaggtgattaatatttgttttaatgatgcaactggcatttaataagtcattgatttttcttagcatcttactaaaatgctttggaacgggggggggcatgggggcatctcctgctgatacaaggcaatattgattatgaattcatacattggattctgggtgctttgttatattgtgtgagcaccgaattacctgatgaatattgattgcaccatgaccattggagaattcccaaggcatcatttatggtcaaggaaaaattacttgttaaccatgaccctgaagttactttgctacaaagatgaggaagtcgttacttgtgacatagagcttatataagctggggagaggggacctctgacctctgacctgttgtgctgcctgcaggttgtgcagagagttccagctttttgagtagccatccttctggacttctggacttctgatggtgttgatacctttgagtcacccatcttctgtaagtaaacccattggttcactaaggcagactcttgtgctgttagtttggtctgttgtcagtttcccatctggatgagtagaaatttgttcatatctccctggaacagtgtcacccacacggggctgtgtattgtctcctatgattgcctttctgtcttgctccaatgcccactattaaggaagagggtacacaggtggtgctgtgtaattgcttgctgttgttccatactgagtgggggatctctctttagcacttagcatctggaatctcttgtctcacagtaggtttattgtgccttggaaatatgattacacttgcctctagctttttcccactccatgttttattgggggggtcttctcaggagcacactatgcaaaacactttaaacacaaaacccaataatttctcacctggagaaagattcatcagatctcttttacataaaaagcaaggtttaataagtaatttttccaagggcatgagtaaatggtgaaatagggactcagattagggtcttttctgactccaaactttgtatcggtatgaagaggcatgcacaactctgggaaaggccaatcccaaatagaaccctcctgcttcacctgtaaagattaacttgtcgggtggtttatggagacagtgaaaggacagaggcagttagcatggcacatcccagaacagtacagtgttctaatacagtagaaatagttggtacaccatacaactttaggttcttaccaactcatgtcttaacaggggccaactaagcttttcttgtgggagcagctcacatgggaagcacagcggggagtcaatgaggaacctcaaggagaagaaatgccttcaagaagacagagtacatagagagccaccatggcagcttacttcagtcagggttctctgggggaacagaactgatggaatgctatgtattatcaaagcaatacaatatgggccaggtagtccagtaaggactgcatgctggagaggctgagaacccagaagctgtccagtccatgaagctagatgccagaggagttctactctgatactgaatgcacaaaggtcccctggtattcagtccatgttggaagcaaaagaagctggagtctgggtaggtagaggagggagggccatagacacactttttcagaaggaagaagtgagcaggcctcagtgtttttcagtggaaactctttacatatgggctcccatatgttagaatatgatttgtcccatcacagttaatgttttttggaaatgtcctctcagccctcccagaggtgtgtatcctaggtagtctcagatcccatcaagttgacacaagattatgatgtgtcagagtaaatcactccaggacaggcagtaagaagatgccctaactacagagagcttaaaagcattgccacaggctagcaagatggctccactttgatgcacaagtatgagtactggagttcaaatctccagaaacctatataaatgccaagtgagtgtgttggcctgcctataattccaacctcagatggtagagacaaggagccccaggggaatctggctagcaagactagctatattgacaagctctgggtttgattggagaccctgcctccatgaataaggtataagagtaacagaggattatttctgacaccaacttcaggctttccactctcgcaggcattctctctctctctctctctctctctctctctctctctctctcacacacacacacacacacacacacacacacaccacatattgtatgtacacttacatactacatacacatgaaaagggaaaaagagaaaaccagagctaagtaaaaacctgccattatgattcttaatggggtcaggggtaaaacaccccttcccaaagaggcagacttctcctcacccctctctgcagcctcgggatgggggtttggaatcaattgtgtttaatgtgctggagtccagagaagaagcatccagagtccggtcttttctgctgttactaaggcacagactgagctctggaaaagcaatgctattccaagggggatgggaccccagttagaacatgcatttgtttttcttattactgctgtaatcaatcaccacaatcctggtggcttaagacaacacaaatgtacacccttagagctccagccatcagaaatctgaaagggtctcactgggttgaagccaggaaggtgtcagcaagatttccttcttaggagtccctaaggaggaacgtctttcctgcttgagaggccacctgcatttcttggctcgtggtgccttcctcctccttcaaagcctgcagtagagcattgtcctgcgatgctctcatttggatccccactctcctgtcccctccttcatttccaaggaccctcatgaccacactgggccacctggataatccaagatgatctccaacctcaaactctttgatgcggtccttatctgcaatgtcccctttaaaagtcagcacatttagggaatctgaggataaggacacaggactcggggagctttatcctgtaggacaagttactagggaggaaatgagatcaggaacacattcccatcctggtgcagctgggtgggaggggatgcctaagcttctctagggagtgcaactctggtaggattagagaactaacacatttaccctaaacacagggagacatagctcctgctaagtaaaagccaggcctgttttacatgctgcaaacaatgcatagcatttatgtaaggccacttcggaactagctgtcacagcttctaatatgattctgtgggttcccagctgaattctgtgcaccttcctcagcatccaacatcctcttacagcttgcctagagtgtgtgtgtgttttccttctttcatttaaacctggggctcccttctgcagggtgtagccaatgcattaagcagccacaaccaaattgcttaatgcccaggtttttaaaaacacctcctttaaatgaaagatttttcaaatacccagacctcatgctgttcaaacggcacaaccagatttttcttctaccagtttgtttggttgaggggggtgcagtggtggccacaggtcattctgattcctgtcaaattctaaatctggatgcttttttagaatgggatggtgggaaaggaccgatgtgttgagtatatgactgctacctattgtagattgatccgttttgcagcagggagggggaatacagggagctgcaggaagaacaagaactctctgagagccagagagtcaccttctaattgccttctccatgacagcatcataagcgtctttatggtggctttatttcacagtgacctgccacactgctgtaattctcccagtgtcagtcatgcaggttttaaaagatgcttggttttatggcttttatttgggaatttgtcaaggtttcacgttacggaagcctcgaagcagcagcctaatagtccataatttggtgtttaaagggatattgccacgtaacctgcctgggcctgcaggtgcctctagcaactgagtccttatgctcaaaggggaaatctccataatttcttttacactacagtaaaccttcactgtcagaagcttccattggaaattctagaggattcctggcatcctgagatgggggagagtctttcaagcttcagaagcagcttgctatttaaacctaatttccatgaaatagacttcaggtgttagtaaagccacactcaggttagtggattctggcaatcggggctgatgtacctgctttatgacgcatagtctggcaatgaaagtactgggccccgagttatacccctcctctttgtcctcctcctcctcctcctcctcctcctcctcctcctcctcctcctctttttatgaagaagcagaacgtgagttgagtttaataatgtcatcgttgagtttagtgtattgtgttgagaacagaacgagcaagggttaccccagctccttcctctccccttggcctcagctccgtgcatacactttggtgtttgtcatagctggctgccccagcttccacatgcctcagcatagctggcacttatttgagcagcgggccatctttctggagtgacctctgccacacaggagactgataagcttttgctctccttccatggtgaggcccctcaggagctcactgtgtagctggggtgggggaagaagcctcgggtactatctttgaacatgtgctcttgattaaacaagaagagaaaaggcccttcgtcatttttcccatttggaggttaaagtggagggtttgtctaaagacagatttcagtaaattgtgggtttatttgaacagtatgtcaacattatttactcacggggggtgtctctcaaattgataggtttcttctaattacctcatcctggaagttgtactccataaacagaaggtatttcagaagccatttgctaagtctggaagggcaaattgactggaaacctggcaggaatgtctttgaaaacctttccatagttctaagaataagaaaacttgattaggaggcagggtgcctctcagcaaactggacactgccttcagtgctcctgcctgcctcttgtcaaaggtggactgtgggactcgtgcataacacaggtcaggccacactgacaatccctttctggggctaggtattgctgtcttgtttatcccactataccagcacctttctcttgggttctgtccatgaagcaagcataaaagatgaatgaaagattcagtcattgaatgagttccaggcatatccaaagacccaaagagttctggcaaatccaggctatggtgatttgaatagatatggcccctatagattcatgtgcttgaatgcttgacctatagatactgtcactgtgggggtgggcttttaggtctcatatgctacaccctgtgtgggacacagttgcttctgctgcctgcagatgaagatgtagaactctcagctcctcctccagaaccatgtctacctgcatgctgccgggatgataatggactaaacctctaaagctgtaagccagcccccagttaagtgttttcctttataagagtttccttggtcatgttatctcttcacagcaatagaatccccaactaagacactggccaaagcacattttcctaaataatgttttcattgattagctggtcctgtctgtctgtctatcatctatctatctttattttaaagacaggatctcatgtagcccaggctatccttgggcaccctcttatcactgaggatgaccgtgaactgttgttcctcctgcatctatcgctcaagttctgggatcacagatgtgtgccactgtacctggcaattgcttggtcttgactagatgagaatgatctggtggaccacagtcatttctatagccaaggtgtacctggggatatagttccaagctgctgcggtaaagcagacaaacacatccatgaaaagcctttgttctgcctcaagttcatagccttttatgactttctcatcaaaacagcatgcagtattctacccctcttcacatgatgagtggtggcaaggaggaacttcaagagcctaaaatccaaaggctgagtggatttggtgcctacacatggtgatgtacctgggccttcagccttcctgcataggtttctgtcacagtgtattgaatggatttagtccttgaaaatatacaccaatattccattcagagaatttcatctgaaataggcagatgcaaaggtgataatgtcagggctgctgatgagcttgtgctgatggtaaatattgaaatatctgtgacaccaaccccggagaacctaggtaccaaagaggaccctaagagagacgtacatgaatctgcctaggagggggaaaaagataaaacctcgtgagtaaattgggaatgtgggggtcaggggaagggcgggaagggagaggggaggagggaaggggagtagggaaaacatatagctcaataaaaagataagaactaaacttgtgtataaacacatagaagaaaaagaactatctgtagttcagtgcatcatcacccactgaatgcccttcatcctggctgtagtaccctggccttatttccaggaccctttcccagtctcctccaatgcctagcacttcagggactccagggcttgactgagcaactgcagtgttcctggagcctcaccagtggcagagtgctgcactccaggcatgtgtgtagttagtctccgagtctcagagagactccctggtgtcattccatcctttaggcagccaggatccttgattacactctgggtttgtgtggaggaggccagacagcagagatttgccagctctgctcccagactcaccagtgaaagctacaaagttttgagccatttgagagatccaagctgttttcctcttgccttccaaacccctttccttccacagaccagtgagaagcccagaagctttcaacatggacaccagtcaggagcaggtctgattccagtctccactctagcccttgctaactccgtgaccctaggcagggcacctgacctctccataccacagtagtttcttctttgaaaaattgatgttgaattctgttccttccagctgaatcagtaagtggattttggtccttaaatttctttcactagaccatcctatcagtgagtgaaccacttgcacttcaagaagaataagaaaaaatactacctgttaataaataatgagtgagtgcactgttttttatttcgaaactcattttggttgttggtagctgtccttaagattaagaacatttaagtctcctgagtgataactattttatttcctgggtggaagagaggaaggaaaggctcaacatctatttcaaaataaataccagtgtaatctaagagttaaccagcacagcctctttgccagcatgctccctgcagaagttagtactgacttgtataacatgatgatgtcaatgaggatgactgcggttaaaatgctgtctacagcacacacctgtgtgttgaggcacaccgataatcccagcacttttggagatggatgcaggagaatcagaagttcaaagtcattctcagctatgcagtgagttttaggccagcctgggctatgtggcgtgtctcataaacacaccaccaccaacaacaacaacaaataaagaggaaagaagaaacgaaggaaagaggatactgtgatgctgtttgcatttgggagggtgttgctctgtattcattagggacagaaacatggttctctctggactttgggttctgacctggcctgtatctcagtgtcttagtgctatgctcttgatagacaagtggctgtgctggagcttagggctatagacactgactttttaaaagtaattttttatctagattctcatatcattctttgctttagtttggctatcccaattgcccccataaacaaaaatcctactggttaggagttacagtcaattcactgcacacatctaattttaaagaaaacttaagctaaaaaatttaatgctttgacttgagaaagcctaagatttctgttaagcattcttcctaacctaagagctaaatcttgacagatgtcattctgaagacactaatgcccagatctgaagtaagtatttgagtccatgaatatgtccaattctttcggcagcttagcctcagacagggtcttatgctgaagacccatcagtcatttgctagcatctgagggtcagcccaaaaagtccttcccaccaacacacttccttcctttttcccccgtggagcctactagagcccagggaaacagccagtcctgacggaagacttaatgatgatgttgaacacctactctcaggatgtctctgcctggagatttactattgcactgcagtcatccctgtaatcctggtgacactcctctggtgatgttcagaccactgtggaatctctttctccttagttccccaaagcacagaggatgtctgtgagcaaatggaagatttcagaaaattttgggcaccgaaaactttggggaagcaaaaagaaataaatacaaagcaaagtgtacccccaaaacagaggttctggtttgccgcactcagctcctcaggtcactggtgcctccactggtgaaacctaccccaaccatctgtcagcctcagactgacccacagacatgaggacttcctccctagctgcctcagcttctgtttctacagccagaagtccgttttccttagatgacagatattaatagtgtctgcctctttgagggacatcaaccatgccacagcagagtcttaatccatggcctctacaagatcaaaatctgcctggattcatagtctcagcagcccaatgagacagacaagaggattgggacctgtaaggaatgccagaaccaaacccaaaggcttcatataatcatggtctcattgttttgtcttgagtcagtctaactctgtggtccaggctggccttaaattcattgtaaccaagtgtggcttgaaagccttgtcctgtctcagcctcttgaatgctgggattatgggtgtcacttcataaccagcttggctttttgtgtttacaacatatttataagttttaggaatttttggtggcacatgggaagaattgaaagttaacaagttagcaataattgtaaagtaatggcttcaatggtacagcgtctcacactggcttacttactttgctgtaactgagcacaatgacatgttcacctgactggttatgccagttctcccaggcaaagttctctctgctcttgatttgatgttgtcatggctgagtgtccctctcccagcaaactatccttttacatcttagggattctgtccatctgggctctgtgatccatctgacagatgtcatggtgatcatggtgtcacgcttagatgttgctgcagtgaagtttgcactgttcaagaattgtttccatgtttttggaactttctctagcacattaaagtgccaaaagaccctagtggacaaatgtatgacattattagagtggcttgcacagtcagaattttctgttatatatttttagtaaatcttattattaaatctatatgattgcttctggacacacacacatatgagagtgggtgcatgtgcataaaaatatttgcatttacatttcccacatgtgtgtggatttagaggtctgtgtgtatgtttttcatgagcagtgtgtcaagggaagctggccaagatataaaaatctacacatcagacttcctcagtgtggactcttgggtcttatggtgttgctactcaaagcaatgggggaatgtttggctgtggatttcctgttcctggaaaactacacagttagaaaaacaatcttttctttcatttgagtgtttccaacgtgccagggtcagaggaagtccttgtagggactgctctcactttcctccctctgctccccacctccagggtctggtcattctagtggctgaagcccatcccacattaaagcagtcagattcaaggcatgcagctatgtccactttggacttgcgccaaaagtattctgccttttgcagggagttaaattgcaggcacaccacaaagaatgttttggaaagtggttttcttttttgctgtgtctgaacttgcacaccagctcagagcccatcgacattctctccatgccaggcttccctggattctgctctgctgccagactggaggttctgagggctggctaccaggagctcaggtgtggaagagatagtgaggtaagttatgttacactcaagttttataaaggaggtgactgtggctcaggggttgagcagcttgctgggggcctcagctgggctctgacaagtgaacaaccatttcattaactgatgttctgtgaactaacatggccagcagctgcacagctacacagcagctacctgaggaagactgacatcaacaaacatttctcatgatgttcagaagaggacctgttctcttcagccacccacttcctgtcttatctcaaatgaccaagaatactagaaccgttggttccattgttggttgattgacaagctctgtagcccaggctcaactggactcacctttgtagctaagctgtagctgtaccaggttcctagaacacctgctaggttagggatgggaggacagacagaacaacttcccagtatgagccaatgtttcttctacctactgcaggcacagcccctaccccactttgcactcctccccaagtgtctccctgggcagagtctggattagagggaactttgagctcctatacctaaatcaaaagtgtagggtttttatttgttttttgttgttgttgttgtttgttttgttttgttttttgtctttggcctggagtgagataggaaggaaaaccaggaagggtttggaattgaagaaccaaattcttcaaatgcctttcaaactatgagaactggttgcatcttcataagtatgcagagagtggggtcagtaaacacctactgatttgcagtgggactaatgtagcttcaaaatatatgaatatagatttgttttgtactatgttcatgacttttatttttcattagactactacatgtcaaaaatgaccaagatgactggggtgggagagaaaaattctaattctcccaatttttttgactccccaaataggagttagatctaagaaaggacaatgatatagaaaggtatccttcactgagtgagaaaagtccctctcatttctcatgcctttatcacacatatgggttagaggtggaccacagtgtgacatactatagacaaagcattagagaaaggtttctaccagtcaggaagtgccttcctctgtgtagagaagcagaggtttggaggaaattcaattcagtagagatgctgtttgcatttctgtaactcaaaaaataaagacccagagttggatattggagttcaaacttcaagctgaagaccagggaagtaaagcagccaactagtagatctaacctctaccaaagctgaaatggcaatcctgtctccatgaatcctcagaggcaaacgctctcagttcctgtctcctcatccttttattctttctctgtccagccataccactcctgtctccacctccctaatgctggaattaaaggcttgtgatcccaagtgctgggatcaaaggcatgaggtctgtactgttttagactgattcaatctagtgtagccctaggtggccttgaactcatagagagatccatctgcctttgtttcctgagtcctgggattaacggaatgtgccaccactgccttgtttctatggctaactgtatggctgctttgctattttgatgtctagtggctttaataaatcataaacaatataccaccatacatttctagaaattcatctagcaccttccattctccaggcttcagccaaaggaaggccaagtggaagatgacagaaaaccttagacaatttaggaacaaactggtctgaggatgtttggactaggggagatgtctgtgtgatctggggtttcctggtgacaaaaattctgtcagtgactgaacttgagtgaggcttccctgagccctcaaacttctttattaggcctcaactttggttcccattttgtctttgacctgttcaaccaaggcttagcaaagactttcactgagtcatctgtcagccttgctatcagccaagtcccttatcttagcctgtctttaccaagagccctgttagaccagttcagcaagaatctcccttctttaatatctctatccccctgtatcctgccccctctccccccctgtattctccccctctccctctttgtaccctattcaacccaaggccttatgtagcccagtttggcttcaaacttggcatgtagctcaggctagccttgaacttctgaaccttttgtctctaccttctgtgctaggattccaaatgtgtaccactgtgcccagctccccttaatgtcccttagtaattttccattcactctgactccttggctctgttttttggcagcttgagccagttagatttttgccaacttgacacacacttgggtcatctggggagacatgagaaaattcttttatcagattggcctgtagacaagtctctgaggaattttcttgattaataattgataggggagggcccagaccaccataggcagtgctacctgaggaaggtagttctgagatgtataaaaaagataactgaacttgagcttggagagcaaccagtaagcagcattcctctagagtctgggtcctgactctggattcctgccctacttgacttcctgccctgacttcccctgatgatggactgtagaataagatgaaataagccctttcctccccaagtttcttttggttgtggttttatcacagcaacagaaagccatcaaggatgctgttcatcttttcctgcctttactgaattcagactcaagtacaatctctctgtcttattgcaacagatgcgagcctttattgtaaaggtcttgaaaaaagtcttccctagcattttaacaaaagtcagattaatttctctttaagactctttttactaccaacaagtgacatagaggaggacctagggtcccacaagaactgaaaggggtcgaaagcaatgaacttacagaggaataagacaagggatcacaacagatggcagcctcctacctggagcaaatgacagggaccctagtcaatgggttccagcataatccccgaaaggtttaacatattggccacatcctgaccaatacgaatagaggacactcagagataggacctggacaaataaaaacttcagacctagagtttccactgccaaccaacctccatcacttccagaggccatattggaaatgaggaagaagactgtggtcaacacttaggagatctaatgttgaattgactcagcaataattcccctcccccatacattaactcagagacagttctcttaaaagcaaaagagactgggatctaacatttttcttagtaaaacatgggaccccacaacaaattgggatatgtcacaggaaacagagagatacaatatattttcatcgttaagttgcaattcccacctcctgtagtgcactaaagaaactgtgctcctttaggggaagcttctggtgtgatttggaaatggtctacagacaaggagagtctagaaaggacaagagtcagggaagggcaaagattttccttccctttgcctgggagctgagacgggcattgataggatacctgggtttccagtgagagacaagaagacaacagcaccttcgtctgcttggagaaactgagctaaagctgaggaggtgacagctaaggtaggatgtgatatgcctctatgggatcttcaatgccagaaggctgcagaaatgagacctgctgtccaatcatggcggctgcatcatagcatgagagaggtgggtgtggggccagataccaacagggaatagacttttcccaaaaactctcattagtcaatggctaccaaacagagggagacccaagagccaccaaggtcattggaggttttgtaccatagatacaaagacctgtcttagaactggcccaaagaaactggctatttatcaggggaatagctgaagtctctgatgggcaggccatttccattgacagcattaatttcatttctcaaagttgcacaaagtgacagcagatatgaccacttccctcaaatgacccaggtttgaattgactccatcccctcacatggctgtggcattagttgctcatctgtgaaatggggattctgatagttcacatttttagggtatgtgaaacctgggccattttctgacctaggaatgggcctgacatacaaagtacctatcatatgagatttgttgttgtcacctgtcagtatgagggtcatgaggaacttgaaatacattaaagaaacaaccaaagaagcatgcttcatgtgcttgctccatctcacccatggtgtgtaaatttggaactctgccataaacagacatctaactccaatagtttcacacctgagatacaggccctggtatatatgccaaaagtcctacttccttcaggtctgaagagatgactcagtctactaattatgaggccccaagttggatccccagaactcatgtgaagaaagcgtgatgacaaatgcttataatcccagtgctaaagagatagggacaggtaaatccctagggctctctggccagccagcctagactatatgatgcattccaggccagtgagaccctgaccaaaaataagaggggtgggaatctcaggaatgatacccaaagttgcctccacatatatgcatgtgtgcctgcatgtgtatgcacacacaaagacaacccacaaagaaagggagagggaggagtgagagagggagatagagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagaagagagatgtttcttttaggaggctttgctcagaagtacagacaacagaaatctgtccctgcacactcaacccctgtttctccagtgatttcttttagcattcaaggccattttcaacccataggcagccgcagctccctaccttggtctgactgcctgtttcagttgtttttcttttatcttgcacaactgggtaaagtggctccctgaatttttatagcttcaggaagaggcaggccattgtaacaaagaagatcctggaagtatattatgcatctctttgaacagaggttccgtgcatgttatttttaaattccaaaccttcgaagcagtgagagttttaggggaacaaattctttgattcaaaacgagactgaatctgcacaaaaataaaatgggaaaaaaaaatcctggtgtcaacagtctgtagtagatcaagctattaagcaagctgaggtcagacttcctagatcagtgtaccctcctcctgatagcactctcagattcacatgggaattttgctcattggggaactagggagaatgattgaggaatacaagtctatagctgccattgggaaggaacttggcatatacatgtcaacatcattccaagccattgtgtgaaaccctgcactagtttcctatactgtgcagacaaatatctaaacacttagtgagttaaaacaatagattttattctccaaccatcatggagtctagaagactgaagtcaagaactgaagtcaagatgttggtggggctgtgctccctcagagactaggtaaaaatcgttctttgcctcccccagtttcccatggctccagatgtccttcatcagcatcactgatcccaggctctgtgggctcctctatctctcctctcttgtttctcagaaggacattcatcactggattgaggcctcactcagatcatccagggttacctcatcttaagatccttactggcatctgcaaagacacttttgctaaataagatcacagtcatgcattctgagcctgggacatagatgtggtttttgggaggtccattgtgatgacctgtgacattctcacaattacattttgaaaatgtctgacattgtttcaaaattcagttattgaaaattttcttacgttgctcaatggttacacttccttttctcccccagtctactctttgagaattaaacatgcccagaaatcactgttttgatccactactctgagatctctggctcttaaaatctttccatcctgtcttatttactgttctcctgctgtaatgaagcaccatgaccaaggcaactcttaagcatttaattgggggcttgcttacagttgcagagagcaagtctatgatcatcatggcaggaaatagacaggcagtagctgagagcttacatactgatccacaggcaataggtagagagaagtgagagactgggcctgatttttgaaaccttaaagcccaaaccctaaaggcatacctcttataagaaatctactcctttagaaatcccatagctactccaagaaatccacaccaactccagcaaggtcacacctcctagtccttcccaaacaattctactgactggggcctaagcattcaaacacaagagagtgggggccattctcattcaaactaccacacaccccttcttctgtcatgtttcctgagccttgaaggagggggtgtggtatatactactaggtgctgagcactttgcagacactaatctttatgttttgaccagttgtgagtctctgtccactgtacaaagaggcttttctgatgaactgggagccacattcatctatgggtatagacatgaattgcaggatggttagatgctatatccatttagcaaagtaatagtagtagttcagctctgaggactatctgtgggttcttggccagatttacgcaaccaggcgggagtttcctcctgtggagaaaggcataatcagaaagtggctggttagctccctaacattcatgtaccaatgggtatattgttccaggttgattgcagcccccaaggttcaaagttgagtaaaactgttgatgattcctgtccacaccccagcagcttggatagcacctttcagcatgctttcagcataaacaacttggggggaagcatctaagtcagtaccagtttgatttctccaagtcctgtgaccatagtataaggtgtcttcagtcataaagtcttagctcaatggctaaacttcttgcaagtgacatagctgacttaaatgcagaacgagggctaaaatttgtaatttattgaatgcatgcctactatgtttcaggaaatatactggcaaagtattatttataaattcttccttccttctttccttccttccttccttctttctttctttccttccttctttctgacaagttcttatgggtcccagcctgacctcaaactcaccatgttgccatgtagccaaagatgaacttgaattcctgatcatccttccacctcctctagaatactgggcttacagttgttactcacttttgaggatcagatttagggcttagttcatgctaggcaagcattctaccaatggagctacattcacagcccccatttctaaatattctaataatactacagaagggtcttcttgcaatttagaggtgaggaaaccgaggctcaaaggagtttttaaagttcaaggccttacattaaaaaaaaaatactggctaaacaggaagttagactcaaaggcaagtcaagatgtatgaaggtaaagaattcactgaagcactgtggggggtgggggggattcaggagggtaggccaatcattactttaggcagataagtctgtggaaagagattaaagttttcaaaatgtttaggaacaatttaaccaatgcagtgcagcagtacatgggtgctttccactctgagtgaagcagagatttggagcctgtcttggtgtcaggccttgtccacaccttgactttgccatattacagagggctgtgttggatgcctaggaaacagttaactgccctggaaagcacttcagagtctcccagatctagatcatcccgttctttgagaaggctctggagttggctcggtgtacatcgttatccttattgatagtcaaggaaatggatttctgaagcaattttttttgctgctgtttgcttcacagaggtgggagcagctcagatcctggctatttggctacagttctagttcttttaccaatttaccaagctggtttggattaagaaaaactatctagagaaaaagagggataaattggctagcattaactttgggtaggaaacacacacacacacacacacacacacacacacggaggggggtcctttcctttctcagttttgaagataaactattacatttcagcattggtactcaaaagcaatttgcaattgaaaaattctttctcgaggccagagggctctttatgtaatcttattttccttgcagtcccaaacaagcaggccaaatgcggtctattatgtccacactggtgtttatagtcccatcttcagttgatggatgttacttaatcatgtggaatctgatattacacagggctgagcccctcttccaaagacccggctgcaaatgccaaaactttatgatggagtcataggactggaatgaatgtgatgtgatactcaacctctgctaactcagataatattctgaaatatccttaagacagtggttctgtctttgtagtgaggcggaggcaattttctaaatgctgctacagagaaaagaatttaaccccaggtgcatttttagcctcccagagactcgttgctttgatgcccagagggatgttctttcttttctcttgagtcattatcccattccaatgcaaagtgcatccttagatgtctagtccctacaccctccaggacatcagctagtgagctgccagcatgcccagcacagtgcccctcgtaggactgactctatatcttaccctctttagttccttactccataatgtcaagccactggacagagtgcatagacaacagtggtcccatagaatacaatgaagctgaaattaaatcctgtcacttaatgatatcacagtcattgcaacactataacaagacattatgctcacccttgtagtgttggtacaaatggacctgtgctgccagttgagtaaaaatacagcacaggggatggcaagatggctcatggacaaaggtgcttgctattaagcatgactacctgagttggatccctggactctcatggaggaaggagaaactgactgctccagttgtgctacaactacacactttctctgtagcacctgcacacacacacacacacacacacacacacacacacacacacacactgacaaaaacatgcactcacacatacacacacacttgagccgactagcacctaactcaagcatctgcctcttcctgtcacttctatacttagatgaaacatcaaacatcaggtgctgaggtctgacacccaggcattgaagcagtcacatgaagtaacttggaaaggtgacaagagatgatgccgggtgggaaataggccttggtaagtaggtgataatcacatgtctccttcattcttcctagagagttgtggaccatggtttttcctagtatcccattccaagatgcccccgtatgccatgggacaagatatgataagagattgggtgcctcatccctatgatccccatggcttgacctaatggacagtcagttctagaaagcacactttcctgtctttccacagccttccttcacctccttcctttttcctgagcctctgttacctgagcctatattttacatgaaaaacactagcgctagtgtggtgacttgaatgagaaagacccccagggtcagtcgccctcctccattttcttcttgcagatcatatgtaaactttcagctgctgctctaacaccatggctgcgactgcctgccatcctgccacgatcatcatggactaaccctctgaagctgtaaccaaaccccctacaaccaaattcttttcctttagaagttgctttggtcatagtgtcttttcacttcaatggaacagcaactaagacactaggtgaccctcattggatggttgaaaaacttcagttacaggcacacctccttccaatttgatccaacacattcctgaagcacctgtgatctgtggccttcctctcagtggcccctgtggtctgtaaagagaatctgactttgttaccaagattaataaccctgtagatttgccctcaagttgtgattttttaacacccatgattgtcatttgtttatcctgtctttttaatttccctaaccccatattttctgactttcatgtccttagtcatgcttatccttcaatctgaaaggattatgtttatacccccacacacacacacacacataagggcaaattcaaattacacattacaagttagttaccctcttctcttctgccaccagcccacaaaactcaataaccccctttctgatcctacaattgtctacaattgtgtctcttgtgatatttcttgcctttcattctattttgtagtatcttgtcataagtcataggtatgttagaatatgtcatgtatcctggaggacacatttcactgttctatgtatgtttcctaagactggcgtaggaccatgtttgttactggtactcgagaaaatgttatgaagtaaatgatccacttgttgtgtaaaagcctttaagtgtttctcacctcaactctcaggtcttaatttttcagggatatacagaggggggaaatgaccatgatgctgcttctatttgtacataaaaaagtcagaagatattaatagtgggatgctgtgcctgtctgcttggtgccatcaaacaatatgccacaggagttagctgaacttggacaattgcttcagacagtaccagattatgtagtagtcccttaagaaatgaatgagctaggcttttgactaattgttccttcctgaaagaatggaagaggtttttgttttgtttttttctctcaaactgttcccagccaagggtttgttacagttctttctccgtgttataaacctgagcacaaaagaactaagcagaaaatgtttaactactgtatttaaacttaatgctatttatagtcactctatattagtcatttctcagacagaggaaatcttcatggaaacagcaggccaaagactggctgagtgcttccctgtacgtattttggaaattcaatcatgtatctgtttacaataagtatcgagtttacaaacaaacctatagagaaattcaatagcattcaaaaggagaacaaaggacattaggaggttcattattttctcatatattaacaaaagttgtgatggtattttgactaagagccatttggatagttttggagaatatagaaagttacaatatgaaaatctacataattcttattaattagaataggagatgtatcttacacataaaacatgcttacacataaaatatgtatttcatatttttaaatgcattgatatgtggccattcacagatgtgttttgttggtagaaacagactttattaaatgaatagggtgagcttctgtgaagcagtcggtaaaacactgacaaatattgacaatgaagagaaagatgctgccaagtttttcgtttttataactataaaagaagaaagaattcagtgggacacagaggatgtcatagagaagtgcctgaactgggaacacgtgagaaatcagcaggcttgtccgcacgggtgttccctgggcatctggaatctgcaatgtggattaccccactgatgcctttgtgactaacgtaagtaaaccagatgactgtgaaccccacatcacttcatagaccccgtgcgtgagtgtcaccctctgcactgggagatactagctcattcttctcagggctttcgtgagttggttcccgccaggatcactgagcttacctcctgccccagctgttctcttggcttcttagtcctgctaaaaagagagaaatcctcctagagaggtgagttggggtataaaccaaggggtggcctctgggtgcaggctcacctggcccagttcagatgactggatatgtggagcatgctcactcttgggtggcatgctctgaaaaccttgggtctaagttgtcttgcagtggttggaagtagccggtttactccttagtgatacgtgttcagctattctgttcaccactgttttccctcttagaacacaggaagagcaatgtttgaacagctgcctagaatcttgaaaggctttttctagtgtgacttttctttcttaggttctcagcagtgtttgccatgcaaccaaatcaattcactaaattaaatatacaccatagtgtgaggtgtgagcaaagaaaaacctgctgggagcaaaataaatgcaaagcacgataatatcagccttcctcccaagtgtattggttttgacactctttgatacttcacacaatcaatagggacagtgctcaaagtggactaaaggctgaggagtcaaagaaaaaaaaatcccaaacatgggctaccctggggttttcttgtttttttgtttcaacttgacacaagccataactatctgagaagaaagaactacaattgagaaaattcctccaaaagataggactgtaggcaagcctttggggtattttctgaaagggcccagccaacttgggtggtgctgcccctgggcaggtgggcttagggtgtatatgaaaacaactgagcaagccatgaggagcaagccagtaagcagcatccctctgtggcttctgcatcagcttctgcctccaggttcctgccttgagctcctgccctgacttcccttgatgatggactatgatgtggaagtgtgagcaaaacaaaacctttctttaccccaggttgcttttggtcatggtgttttatcacagctatagaaattgtaactaaaatacatgctataaaattttgattaaaaggaaccgaaggatttctgggctgcattagacaattttgatgaattttggggaattctagctttttagccttgtaaatagtgtagcctatagagaggaaaagcttagctcaaatagcacagcctacaacctaacctttagtataatatgcttccatcattcccagaggagccaaatggcccagaagctcgctgcagagcgcttttaagcggtgtctgcgttgttggaaagtgcattctgagactactgtaggaagtgactctcccatcatgtctatgaaaagtttttactatgtatgcattttactttgggactcaagcagtccatagacgcctaaatctacattctccacagagtctggtcccctgcaggacactaagaattaaatattaagcaactgtaataatgttaatatccatgacgagtgtcttaagtttaatgtttaattcttgctaatctccagggtgtttggcttcaaatgcatgcctagtaatggctaagtggtgcatcctactcttacctctgccctccttcgttaaacctccaattgttaacactcaggtggaaacacttgccttgaaattatatcctgcttaatccttatagtgacctatgtgctatgcattattgggtttatattcatgcaaacgaggtccaggagattagttgcctgtctaaattttacaactaactagatgccagagccaggagttgagtggtagtgtggaagtccttgatctctgcactcaggacggccacattgccacccatgagacttagtcatccaagactacttcaggaagagagagagagagagagagagagagagagagagagagagagcacaaatgaaagagatttgggcacccaaagcagggcaactgttggtgttgagggctgtagattttaataacataatgatccacttgactggaaagaacagggaagatgggagagactgagtgtaactacagaaaaaactacttgattctttcttcactgctcagtttcacttttttaaagatttatttttgctgtgcgtgcgtgcgtgcgtgcgtgcgtgcgtgcgtgcgtgtgtgcgtgtgtgagtgtgtgtgtaactaaataccagaagccatcagatctcctggcactggattcacaggctggtgtgagcagcttgacatgggttctggttccccacccagatcctctgcaagagaagaaagtgctcttaaacaggggccttctctctagccccttggtctcatgtattaaaagcaagtatttaaagctcttgaagttattttgatgttgacacagtgatatggagccagggttatcagaggctgtcctagtggtcaagcatattgacccagtttttaccagcagggggcagctggcatttctccgttggtttcttgatatgtcataaaagcaaagagtgccttggctggctaccacagccacccaagttgggtagacaaagaaagggtaacaaaacacagaacatcagctgagagggggttttgctattttactttgtaaacagtctctctctttctctctctccctccctccgcctctcctctttcccctccctctcttatttacagtttttgagaatttcatacataagtactgcatttgcgtgattcccattcctctctctccctccaactcctaccatatcccactattccctctcaaattctataatttttattatctctctctctctctctctctctctctctctctctctctctctctcttctgtgctctcctgagtctatttagtgctgctcattcatacaagtgtttagagttgaccacttgggatttgataacctattagggactagtccctgcaagagaatgactctccctctctcggcagccattaattgttgtagttcttcatttagacataggccctttcaaaatttcccccatgcacattagcatgtcagttggtgtggtcattattcaggtcttgtttaggtgatcatagtgttgatatttcgtgagtgcaccctgccacgttgttaggtagaagacactgtctagcaacaggcatcccaactacgctctcttgtatcccaggctggtccaggccttactatgtatcagatgatggcctagtgctgagatttcagatgagcactgccaagttccatttatgtggtgctgacccaggacttcacacatgctaggtgagcactctttcaactcactctttctctagcctcagcttagtgtaattgttgaaggttcttctgaaaaccctgataatcagtgttgttcagtagaattcatcacagggtaccgggtttctctccaaaatttagacacattttatcaactgaagagaaaaaaaattcaagactgtgctattcagctttgttattcaagatcagaataagtgtcttaaatatcttattagttgttagaagtccagtttgtacttgtcttttatgaacaaggaatgccaaggtctgtgaaggagactgataacaatggtctgttcactttcaagaaggaagcattttctctccatcacataaaagctgctgaataaagaaaatcacagatttatatcattctgggcagctgagttatgatttagtaacgagtcagtcaaggctaagaaaatggccaagagcctggtagtgtgattataatgaaccgctgtagagtgtgaggaatgtaagaaaaagaaatagccccagaagaagcaatgtgccaaaaaaagtcccacagcactatgtacaaggcctccaaggtgttctgaccctaccacttcacttttcatacttccccaagtacaaacagggagatggtaaaaccgaatactgatggaaatgtctggctttctttttttttttttaaacacagactctagggatcaaagtcaggtctttttgcttaaaaggcaaccactttattgaccaagccatcacctcagcctgcgccttggaatgctgaggtggttccagtacctcaagtccttttgtcctagactatgagtgattctaaagccaaggctttgcatggaacccccagggaaaccatagcgggtctgtgaaataaactagtaatcaggtggttaataggggaagggacatgggtttatcaagactttgtctctcttgtggggacattgcagaaaagagtgacaggagtggtgaaggttgaagagagtgtgaggtaggttgctgagcaagcatggtggggcttttagaagagatgaatgtctcctagaagaatgggcaggggacagaagagtggctttaagttctgccaccctcttctctcctctcttgtgacaggaattacactcctctgactcatgaaattctcaggcaggaaaatttggcaattcagttaggtcagaggataacttccaggaatcagttctcactgtgtgcgtccatgtgtttcaccatgaactcttgttatcaatcttggtggcaaccacctgcaccctgtgagccatattgctggcccccatccaatttcttccatagaatccatctttagtcagattgggaagttcagaggaagtctgcccttacacttgctgtttctcagttgcctctgctttaaaacaatatgccaaagtgacatatctaagggcatcatgtcctgacccctttcaccctctctcagagacctcagatgctgacactgcagcctttcaaatcaaaatgtggaagagcctggaggtatgtccctgtgttagtcagccaggactgctgtgacaaaattcctcagactgctgtggtacacaccataggaattgactccttgcagttctagaagctgggttggttaagatccaagttgcatcctcaggcctcctacttccttgctgtgtgctcagagaactctttgttcaaggacatagcctgttctctgtggtttcttctggaagtactaaacctgcatacatgaccttggctgtctttagctcccatacataggagttatctccacatttaggagagcatctatgctccaatcacccccccccaaaaaaagctcaattcagtccatagcggccccttcctgggtggatgtggggctgacttctcagggcaggcaagacccttcccttgtgaccattcaggcacttacttaagtagaaggaaaaaatcaatagtatttccttcccagggaagctgtgatggttggttttaaagtcaacttgccacaaattagaatctcctaattagggagcctcacttgagaaattgtcataattgccttaacccatgtgggaagacccaccccaaatgtgggcagaaccttctggtagcaacccagataagaaaggagcacggcactctgtgccaactagggccttccttctcatcgcggagctgacatccatgttgctgtttctgattcttcactggtatctgaaccagtgttcccaggcttccagcactgactaaggaccagtgaacctcccagaaccttccacgtttctagtgacaggttaggactgttgaggcactcagccttgtgcagggagcaaataccagattgaaggttctaggcctcttcggggtaaaagagccaccatgggattactctggctgctgaggccccagcctcaaatacctaacagctactgggttctcaggttctctgatatgatttagctgttattattttgaagaaaaatgatttaatagttgtaaaatatttgtataggtcatattggttctgtttctctggagagcactgaccagtacttgggcttccgggttctatagaggctacaacaatcacaatgtggatttgggggttttattattattttatgtatataggtattttgcctgcatatatggtaccatgtgaatgccttggagatgagggagggtattgagtctcctgggaccggagttacagatggctgtgagttgctacatgggtgctggtaatcgaacccggggctctggaagatcagtcagtacttttacatgctgctgagccatcctgagatagcatgaatgtttgagtgtgtgctcatattacacattagaatggtttaaatcaaaacctctttcttctttaacttggaacttttgacatccaatgctaacctgtctctggggactggattctgggttttacagatccaccagaaaagggccctgccctttggtgactcccatagtgagactgcctcaggtaagccagcttcccagtaacacactctgggcttctaaaccattatgggtaaaaggagacctcaggaatcagctggctgctgcaggggaagcaattgaagttgttaacttgttttcttccaaccccgaaaagggcattcctttgttctcaactgaccaaaaaatgctttaaaacacttgagcgggagcagtttacaaatgccagtgtagggatggcgcttatcagtttgacctccttttccaggctggagaagcctgtgtgtgtggtctcctaacaacacctgtctgaagacacacctcccacagaggtgctgacaggaagcaggagaagccagaacagtgtggcctgctttcaggacacttcagacatttccctttgtctatgcatccctttgggagattttgatccaatctgccacagtaagatgctttcaccattacaagtggaaaagaaaggaaggggggaaaacttccattttccttctaagaaatgaatttttatttctgtatgagaaagctttggaaggaaggcctggtgtgatgcagggacaatcttttcccagccattcaacatcagcaggctgtgtgtccgaaccacagaggcggctcctaaaatatctgtcaaaggaattgcttcgaggataaagggtctttaaggacctaatgagggctactgactctaatgacagcgtgctctctgtggcagggcaacaatcttcatgagccctgttcataaggaacagaggttgtgagatggcccagtgggcatgtaggccactgttgtgattggtattgtctgattggtattgctaatgtggctgggcacaggctgcacacttttgctccagttcctggacatctagaagaaatgtgttagaatgactgtaactccatctccctcctggcttcacccaggatcgtggtgacaagtcgttaactggactcttgaaaaaagaaaccacacatagaggtgtaggtcagaggagtggcatgtcccttcctggtgagaaaggggaaagctgctttctgacaattcccaccgacataaacggatgagaaagctcttaataaggactgttctgtttcattctaaaccaactcgaaagacctcaatgtcataatttactctcctgagaagttatgtgacttcagggctccagccagaaccacagagaaattagaggttcgtgagtgactcttcggaccaaaccttcaaagactcggaaggggcagagggaacacaatggatcattacaaaacaggatgaggcaagtgggggagcattcacctatgacatcacctgcttctaaatgaggaaatatgacacagccagttgaagagcactgtgtaccgaatatcacatagctcatcacttcagcaacatggtacactatactggtgtcacattccttttagtaaaataggagttcaactatgcagattccaacgaaccacaattgagtgaagtacattgtgtgcaggaaacatggtttccatgcctctctgctaacagcaggcaccgatcccttctagaaacaatgctgcaacaagcatcctgtctgtggaactgtctcaactgaaattgttatttcttaagtgataaatatttcactggagatggcatggccatcgtactcatgtgcatattggcaactctaattggactcagggaattatgaaatcaaagaggacatacatatagagttaattcattaatttgcagatgcatctatctcagtgagtctgctctttactataaagtgtgaatctctacatatcacttctaatttgcactgcttttaatgatattctataaatctttcctagatgtgtttcttttctttttttttttttagatgtgtttctttcacttagacaaatgaagttgaaaggtccatgagtgtgttctagaacttcacatggtattgtcaaatttgtaccgatttctatgcctttatattgtataaccattaccatgtcacacccaggcagagtggcacacaactgcaattccagctcatgggaagtagaggcaggaagagcaaatgttctcactcaatcttggctacatagagaggtcaaggacagccagggttatgtagtgagatcaaagtcagtctgagttacaagagacccttagggatctagggaagttctgagtgaaggtgttattttttgacatgggcatgcctaagactcctgagggtggcaaagctttctctgggtgtggcacacagggaaatggcacaacctctctcttgtctgggtgcagatgttgagtgtgcagaagttctctactatagctttctcccctgggtgtttatggcttggaggctgctcccctgtagtccataaggtctccataaggagaccagctagtccacctcctattcagctatctataatagccgtggatccttgtttatctgtatgtgataaacccaccttcctgttcaactgtatatagccaacatgctaagctttctgtggttactccatcagagagcctggtctatccaatcccagctttcttgtatgtctgtgtgtctgtcatttcttcatttcctcaccactctagttagttcaggccctggaggcctgcagaagctggcaagactcagtctcagaagagaacaaacaaaaaagacttaccatttcttcacatttttacactgcctttcatcccccccagtcttctaatatgaaatattacctcatgttaatttttatattaccccaagatttccagtgagtaaaggttatttttaaaaatttatctgccactggttttcctcatctttaaactcatcctttgtaaattttcttcttttgggtgagttgtctttttcatattgattcagaaagattctttgtaagcatatgaaattgccattttgtaggtcagaaattatatattggcaatttcgcacagatgaaacaagttttctggatactaatctttggatccttttgtgagtggcagctaccctcttccagtttatgattttcttttaaatgtatttgtggcaacttttgatgtgcagaagaaaatattaatacagccacccttccatacccatgggttatgtgtttggagtttcaatcatcacagacagaaaatagaaaataaaactacatctgtgctaaacatatatagacttccttcctgtcattattcttcaaacagcacaatattgcatttatattggagattactgagagcatgcaaacagcatgatattatatataagggacttgatcctctgcagatgttggtattgtgaaagggtgggggctgacccactcccccatgaacacggagatgattcgatagccagtttattaacactgtcctttgccatttatgttttatctgtgtcttgttagatttcccaaaggtgggaactctaggttaaatggtaaatgtgtatgtgtttaacttttgcttaaacgtcgaacagcaggatgagagtgagtgactccaaaccagactaaaacaaaagcatatcatggttgttttcctttgtgtttccccaacaggcggtgaaatgaacatctttttatgggttctaatcagcatttagatgcacttatctgttagttttctcccctgttatttgcacgtctgcttctgcactgtctgtctatttcttactaatctgtaggtgttatttggtgtgcatgtattaactccttgtctggcatatccatggcaactttcttctcatttaacatttgggtttttaaatgcaacacttgtatatttttctatacccaaactttacatttccatatatcaagcatgctgttctttcgccatttctgagtttatttatttattttttcaatgtaaagcaaagaaaggcacctctggtcctatttctacccatatctccaggaacttctgagggccattggcttgttgtgttgtgatttcttcttgctttcctccatgctctcctcctcttcactgtccttcactgctgcttctgatcactttctttagttttgatttctgcttttattatttttaattaatcttaggctaccatacagttgggttccattgtggctttttcaggtatatgtttgtttgtatttacaccctctgttctctcctgccctcacactgattccgtcacctccccccaccccccatagtccaactactgttttctggtcacttgtatcttattaccccctctttccccatctgttttttaaagctctcttttttcttcctatagtcccttttctagtttctcccctctctccccctccctctcactctctccccctccctctcactctccccccaccacacacatacagattccacagatttgtctctctatacccagcttatttacttagcacattgctccattccttttcctacatgtgtcacaattttatgccccttcacagttcactgaaattccattgtgtgtatgagtaaatgagtaaatgttcttcctccactcatctggtttcatttctcagtttttgtaaacagtaccacaataaacatgaatgtgcatgtttttcagtggcaggacttggagtctttggggaatatagctaggagtagtgtggttgggtatatggtgattctaggggtagatttgtaaagtatatccatactgctttccacagtggctgtactgaccaaatgtatatccccactagtggtatataagtgctcgtgtgtgtgtgtgtgtgtgtgtgtgtgtgtgtgtgtgtgtgtgtgcgcgcacacgtgcgcgcgtgctcacaggcacacatgaattcattttcatgtttgtgtaggagaaggttagacgtcacacaggcatcattcctcaggaatgtggccactttatttctgagatgatgtctctcacttgcttggaacccactgatttgattgctaaccactgagtcttggtgatctccttgcccctacctcatccctctccagaactgagattacaagtgtgtagcactatgcatggccttttaacaggcttctggtccttgaacttgagtacttaacacctccccccaaactgggtcttcttgcttgcttgccagcctttctgctctgcctgcctggcagtgaccacagacttaaatgacctttagcttggaaagtgcttttctaactaggaagttaggattttactcgtagtatcacaggttaagcagacaagcactagacctaacagctggcctggctccttctgggctgcctgccagtgtgttaacacaggacacgctccctgacacaggtatttccacacaccagaagccttctctgctcactttctctcctctgggccctggaggcctgagcagctgtgccataatgtccaggtcactgggagaagctgcctcatcccagtggagatggctctgagacaccactctcaaaagctaattgagttgctgtaatagatttgttctcagtttcaaccttttaacagtctcatgtgccgctgtggagctcacaagtggttttcacctactgctctacctagttcagtagttcttagcagagcctctccaatgccagatgcagcctggcactgcttggcctcccaggggaggcctcagcacagcattctggagcaccatgctggggtgggcaaggatagctgttttctccacaggtgaaccagtagccattatccctgaagatgaagctacacttaatgcatagtggtttagaccccaggatctaagatttagagtcaggcagggtcttgataccacattccccagctaatccttcccatgctttcttgcttagtattaagacatcaacacacacccctagttttggatgaccagtccaactcataaaccattttttaaattgcaaatcttcagcaaataacattttttatttaaaattgggtgacaggttagaatataacctgattctagagaagtttttaatgttagacatgcctagattctgtttcattgaaaggtaagcggggcacaatagtggttacctgtagtcacagctcttcaggaggctgagacaggaggattgctagagcccaggagtttccatccagaatgggcaatatgtgcctcttctcttgccaagatagatagatagatagatagatagatagatagatagatagatagatagatagataggagagatcccatcctcatcaggaatgagatagatagatagatatttttttaaaaatccagaagggtgttaagtttattaagcataaagggctttatggggaagaaggggcacggaacagggttttatgtggtctaggctggcttcagacttgctacatagctgagaatgaccttggacttctaatcctcctatctctacctcccacatggtgtggattacctgtatgtgccaacatgcccagtttatgcaatgctgaagacagagcctagggcttttgtgtgtgcttacaacctaccgagccacatcctcagcccaagcatgaagtggaaaatcaagttttctcatttcctatgtgcttctggtgagttttgatgtatatgtggtccagtgggccgactctctgtgttccaaacccaagaacactactgtttctttgagcctgtttcttatgggaggcataggtgcaaagaaacaaagaatacatttaagagataaaaatccaatatgcctctcaaagcatgaagaaagaaccatccaactgcaagagacattttcagccattttccttactaggggttatgacttggggctcaaagcattatttgtaatgcatagtgctgttcatatgataaaagtatctttgtttttccataatcaaacaaacctggctctcaagttctgataggcagtgtataatattatttagaaatagctcagtcttttcttgtttaatatctagtatatatttgggcaactacaagattatcccatttgtgattcttttcctcctcaggagagagcctagttctcatctcatcctggtgctagctcttctctagtcactacctcagtgaaggagtgacttgttcctagtttctggacattggtcatacccacagctaggagtcaacccaaatgccctaagtcacaaacttcatgttacccttgacccacctaagacttctgtggtctacagtcaccttcaggatgtctgagaacacccagctgcctatctgtacacccaagggaatagaagggcaagtaataataaggccacgttagcccaggtccatggatgctcaccccagttcaatgaatgctcaggatgagtgggaccactgaagtacatgtatctaattagctaccatttcaaaaacttctacacattaaccggctgttcttgcaacttaacctggtttatcagatgctggatgcaatcctagcatttgcaagattttttataaataatattgcctctcaatgcaaaccagctacttaatctagtacctaacaaaatctatgagaaatattatggcctacacttacccaggcatggtacctgcttatttcctgtggtacccacctaagggaattccagaggcagtttttcttatgcatgattttcacctgtgaaatgaaattcccgggaaaaatgtctacactatgtcaaacattctgcaagactctttttgtttgtgaaagatggaatggaggataaaattatcttgggctattttttatccactagtcattcattgctcatctctatgggtgacctaccatccttaggattataatatatgtatatgttatacactatatatatttggaatgaacaaacagacccttagcttctgttaacctaaaaactaaagatgtcatcaaaaactatctgaggactagtcctggttagttttatgtcaacttgaaacaaactagagtcatcagagaagaggtaacctcagttgaaaaaatgccccccccccgtaagatccagctggagatgttttcctaattagtgatcaatgagggagggcccagcccattgtgagtcttgccatctcggggctggtggtcctagttactaaagaaagcaggctgagcaagccatgataatgccaggaaacagcactcctccatggcctctgcgtcagcctccaggctcatgccctgcttgagttcctgtcctgacttcctttgatgatgaactgtgatgtggaagcagaagccgaatcaaccctttcctctccaggttgctttggtcatgggctgtcatcacagcagttgtaacctgactaagaccctgagattgtaacccatcttccagatgttcccagcaatgtatttgaaaaacactgtcttttctaactttccttgttctgtcgctgtcctgaaagacttcacgaagctgttcccacgttggaacatggcatttgaggtagcatgaatctgtgttcccaggccatagccccactcatagttggctgcagaataaatccatattcccccttctccctccctccttctctcctcctctccctccccctccttttctctttcacattccctgtaaggtaggaactgcaccttttgcattgacacttcatatgctgcaatcttataatcttgtccttttgaagatgcgaccacatagagttttcttgtgttctgtgtttgacttatttctgtgctctgtgctcaacgacttgagttgcagcaagtggaagagaactaacaaaagcaaaatgcttatagcgtgactggaggcagaatctcccagctgaggcaaagagagctgcctttaaggatccattctagccaggctggtaccaaaggctgaggcaggagaatttcgaagtctgaggacagcctgcgctacatcttctctctcagcaatttggaagtctcccatacaggactgtaaaccacagtcaccatgcttctatgtaatgaatcttggtgccccttcacttacattgcccctctgtctccctatccccttacctgacaaccactgcttcaatgttgtccccaggtttgtcacttgtagagtctgtacacagtaaagctgtgtcttactggagactgttcaggacaagcagtgctgtggtgttagccccggcactacctgcttgccagggcctttgccacctccttcacacctaccatcgctccccgtgttctcagtgttctttcatttcctcctctcctcttggatgttctgcctctactgagagacacctcacttccttttcacaattaccttgctgtttttctttacaataccctcactctgtgtgtgtgtgtgtgtgtgtgtgcgcgcgcgcgcgcgtgcgcgtatgcatgtgtgtgcccttttctgcttgctgagtccctgctccatccccaatacctggagggtcttcagcaggcagcagctgcccctgagtatgtgctgaatgaatgccatgcttgggcatttacacaaatgtgggtcctgtctcctgattcctctttggagacaccacaaacaagtcttgtgctatgtcagttgtacatagcctgctctgcctgtgtctccaatgaactggccctctactaattgcaaacttagaataaggaaatgtttctttcttattttttgtatcctcgaatcccccatccatacagtttcttcttatatcaggacttataaagagttttgtaattttctgggcacgtggaatccctctgtctttgtctttttgtgtgccacggacagaggtttgcttcatgatttttctgcacccctaaaaatatcacccaaacacagaagtatttaggaaagcattctggtttgctggaatatctaaagagctcaccacagataacacaggctgggcttggtgcaccaccagctttcagagggagtaggctgctgtctgtcacagctgcaggcctgccatatccccaggactgcacacctcagcaggcttggactaaaccagcagaacacaagacccttccaaacctgtttctctcgcatctggtagagtacaatactaacaaccaccaaccgctgacagtgctcgctctcctgccaggagcccatttagtactttgcattcattttctcaattaatccttactggaggcatgggctattattgccttcctttttacacaagtgaaaactccagcacagaaagattaagctacttgcccaaggtcacacggtaattggcaggcctggggttcaaacccagggtagctgttcctgagcttattgtcttcattcttactttatggctgctgtgcaatctagtacacacagccagtcacgaatattcttttggccaggttagcctcctatttgatgcttaatctacaaagagaatattagtgtgattaaaacttttaaacaaaaggatgaggagatgtctctgtgggtaagggcacttgcaggactcatcctgtaaaaagatggatgtgtctgcatgtgcttaaaactccaggactgtgaaggcagagtggaggatcactggggcttgcttgtgttagcccacatcactaaacttgctgtctcaagagtggacctgctagaacaggatgactcctctggcctccatgagtgcccttaggtgtgcccacccgcaggcatgcatgtgtacataccacataatacacctcacacacactaacacacaaaacaaaaaacaataaataaatttaaaaaacatattccagcctgtgatggggtacctttgctaagctgtgccacacagggaacacaggctacaggtgttggttggaaccctacactcaagtaacccacacttccaagataaaccgaagcctccgtgtttgtactctgctttgaaggtacgcatctctgatggtctaaggacttccacaggccactaatgggcctgtgtatggaccagttgtcctatgaggggagggaattagtttccctttggcctttggctaaaaccacaggtcttcacagaatgaggctgctctatccaacgagtgtagcctgtgaaataatttcatgggctgtggggctttgacagcgataattcttggatgtcaaaaggataaggacacagttttctgcttctaattttattcataggaaatgatggtattgagctgtccgaagagtacccctgtggattaattccagtttctcttttgtggaggagacttaagggaagccttaatctgctttatatttaactcttatctccttgctatgaattaaaaatagaacgctggactgcagtctggcctccccagactcccagggttcaaattacccagggtgaggatggatgccaagctgccccaggcctctctgtggttcagcaactctcatcgacttcctaaacacctgccgctctgatttttccatccaagtgctacgcattaacctgtctagcacgagaagtcctcaatctacagttcctgaatggcagttagcattttccccatcatgaaacccaactccctaatctatttagaatgtgtaatgttcctgctttatttttattatttttaagacaggctttcatgtggcctggctggtctggaacttgccaaggatgaccatgaatttcatatcctcctgcctccaccttctgagtgctatgataaaccatgcctggcttatgtggtgctcaggatcaaactcagagtccagtgtacactagataagctctctagagttgagtcacagccctctcacattctttttccttttccttcaacatatcttttgtcctttcctaaaggatgtctaagacagaggaaagggccaaggttcaggccttgcttcaaggttactcagggttgtgtcatttcaactgccctgtgagtgtcacagtgttaagagaaagggtattgaaggggtgactgggccaccagagctcctgagaggaaggcaaggccttatcagagggctttcaactgcctgtggctgaaagtttacattggctgacctcactctgttctttagctctcaacctctgtgtgccatcacaattcctctatcaccacacagccccacccactcagcctcctgaactgtgagaaataaatctacgtgtttaatgaattctctagactctggtattgtgctatgtagcagcaaatgaagagaagagtcattaacccaacagtcagtcatctggtcagtgtggaaagggaagcatagttgataggaacacacatcgctgtagattcggcctggccaggtcagcccatctgggaaagactgtgtatcttaaccaggtgcaagggcaaagccaagacccttcatcgatagtgtcctgttctctgttccttctttggcccccatagtgagtttcaactccagtctcttgaattagaataccaaagaaagtggtcatgtgtgtgatggtcacagacactcttctgaccccactggtgaggaagagcccttgtggccttttctgcttccctaccatagatgatgaccagctacttctgtgccttaatatggggtgcagaacaagcaaagaaaagagagtccctcacaccaaggacgtcttacccctctggataaatatgcacccccttcccaacagagaggctgagcagagcagaaagacaagcgacatggactggcaccctggaccagaaggtagaacggagcagaaaaaagaaaagtatcagatggtattggatgtgtgggggtgtcactttatgaaacttggctccagttaaatgcacacatcatctgtctgatgtggagagtcaaacagtgctcttagtatctgtgggcactgcatttcccagcccctttctagctggccacgtgactgagagctgcttgttgggatctgactaatgggacacatgtacctgaacccttctacacaggctactcaactgtgtgtgtatgtgagtgtgtgtatgtgtgtgtgtgtgtgtgtgtgtgtaagagaggaaagagatgggtatttacatgtggtttatgcatttactgcagattttggagtatgtaaaaaaaactgaaagtggctgctctagacagagtacctcaaatatgctgtggatcagctgcagctaaactgctcctggtagtcactgtaaacatagactatggatcctaccaagatctactgagttggggatttgacatgcttaacaaacaccacagagctgctgcgcgagcactaaagtcgaaaaccactttaggcctggcatctgtaaaagggttttcctggcagccttggggctgtttaaaccatcaatcttcatacctattttctttggtcactatccaaagaatgaaccttcctattccccactccatccatgcgctgtacaatcttatcacaataactctctgtgcagattctcctaaccctttcagaagccccctcctctcacccttctccctcctccctccccctccctcctccctctcccactcctgaactctcaggcccttggaacagcctgttatgtaattaccaaagccccaaacactaccaccttttccacatcattttcagagtcaaaggaaagcaacttggtagatgatctctttgtgtctggaaagtgggtcaagtcccctctaatgtcttcactgctgctcctgagtcataggtttcccaccctttaggacaagctttgtcaattaggatgcttttggcagtaagtcatgcagtgttcaactgccaggacctaacaaaggaacatttattattatagtgcatggtaaatggaagagttccatgataattgactagttcaacaggtctttctgctccgtttcatccaggatgttggattttatcctcaggcttgttccatgatggttacaagacagctgcagcaactccagccatggcacccttcacagctatgtcagtgttgatcacccatagctcttctaacaattaacacaggcttcggacttggaacaacagaattgtattctcctagaggcggaactccgttgtcactggagtgaaatgaaggggtcagtgggttctgcagcctctgaaggttctacaggagaagttggcccgtgtctcctgcagtttctgatggttcgagcatgcctaggctatggtggctcccctctatcctctgtgtttgtaccgagtatatgtgagtttctttagtccatcagttctccctctccttctcttttacagacactgagattgcattagtacctgtctggatggtgtgagagaacatcccaatcccacaactgcaaatgtaatcataactgtaaagaccctcttcccaaaccgccaaggcttttccccagcccggtacaatgccacaccctaggatgtgcagaattttctcatccgaaatgtccatttttcctttctgtttgtttatttgtttgagacagccaaggatgaccttcaatttctgatccctttgcctccacctcccaggtactggggttatatttgtgcaccactgtgcccagcttgcttcatgcacaacaggcaagcagtctactgactgagccacatctcagcttccttcatctataaatcctttccagggagaaaaatcttcactgagcaccttcaacatgttggccccagacctactagctggacagggctcatgaatatagtatacagcctcttagagaaggaagctgtgtcagcaaggaaagtggtcagagagcaagaatgaactgttgtgttattggaatactgtctctgcccttccaacgttttatctttatttaggttttctccacaaccacagaggacttcagcacctgtgtcagattcttttgcatgacccacctaatgagcaaccactggactctttgaccttgtcattatccagtgacctcacataccatctctgccttccatcccggcttcagtctgcgcctggccatcacttcctctgaatagccagtatgatgtccactaccttgattagctctaccttcttggcttattttcattcagtgttcaggccagagatgtactgtgctcttggccatgtgtcagtccgacagttggtggttctgttgaagtcgtctagtcaccaagtcctggatgaccatcccctgttatctccttgttcaaacttccattgcccttcattcacaccccttcgccctcactgaggcacttcacttcacattcccaattaacaggagagcctggtggacaggctctcctaccgtaactcatcctcttacttgtccatgtcctgagatgctgaactgtccatcttttcaatgaggtggaactttagccacttctgtctctaatggaagccagctttctttgacttggctctgaagattccatgttccattgtcctttcccagcccctggctgcttccttcatagaacaggcaagtgggttggtatggaagaagaaactgcagccccccatcacccatgaataattctggtctagtttgcctggtgttttatctttccttatttctcagtctctctctctctctctctctctctctctctcttctctctcctctttctccccttctttcattatttcccttccttccatctcttcctattttggtttccatgcagtctttgcttttgtttagatgttaagtaaaagagtagaaaagacctgcagctcctacatcaatatcctcatgtactcatcctcactattcacattcttttcctaaatgaaaatattcaggatacaagagtacttgtttcattgcttcccaaagggacacagaaaacatctgcatgagaggaaaacaaaatcggttttgaacatagagaaagggtcttgccagaggcagccaaaaagagagagctgcaccggggtgatttacttctccttgtccagccttccctccctctacatggttctccaagggcagttgtgaggatgcctcattgtttactcccctctaaaaccatcttgactcatgtttgtgcttgactaatgtgcacaaagctctgggtccaatccccagtgctgcttacacatgggcttggtggtgcatgccagtgatcccaacattggggaggtagaggtcaaagggtcaaaagtgtaaggccatcctgtgctgcatagcaaacaagtccatcttgagctacaaaagacattatctcaaaaatactccatacaatagcaaagaagaaaccctttctgactttggtgtggggcattgtctatgctcccaggtacccactgatgcttgctgttgccagattttgtcctaccgctctactttgcccatgctcttctcaggaccacctccctcccctttcctagcatacactcagtccccacaaggctcagcttctgtggcatttcttgactccatttatttcgtttttttaaactgttttccttcattctgtgtttccctctaatatatacatatatatatatatacatatatatgtatacacacacacacacacacacacacacacactgtgcctgttcagttgttctctgctcacaaaactcttgaattttctttccataaaggaatctgtaaactctgagtgtggtggctgacacctgttatcccagcactcaggaagcagatgcaggagggcagcctggctacaccataagattctgtctcaaataaaatagttactacagtagtaaaataaaatcccagggtttctctccctttcctgattcatgactctccaatgtccagctgagtactctgagattgactttgaactcctgatcctctgactgagtgctaggaatagctgtgcaccacctcaccctgttcattaggtgctggggatcaaatccagagtttgtgtatgctaagcaagcattcttgccaactgagccacatcctcagatcaaaacaggactgctttcccatactttgtttgtttgtttgtttgttgtttttaatcatgtgtgggcatgggttgtgtgagtgagtaagggacaacttttgggagtcggttatctttccaccacaaaatcaggtcaccaggcttgctgggtaaacacctttacctgctgagccacttccctggcctaagtccgttggactgtcttgcatgaatgacagaatgtatctttctaaagtagctggttttccaacagtggtgtgtctgaccataaatccaagcttcactacccgttcagagcctggcatcttcaatccaaggctgcaccaccctgtactctcttgtggtttatttttgctaactcactgtctgagtttcagtctctgtcagctcctgtttacttgggccactcaaagctctgctcttcagctggggcagtatacaccaggaggaagttccccgctgcctgcacagggcaaattggtttctaaacgggcttgcccacagtctccattaatatcctatcagagagcaaggcagcataaaacagtgagagaagcaggagttactttttaggatgattgaatatgatgagggaaccaaggacaaagggtaatttattccaaaggaaggcaacacctttgctttgcaatagctcttgcagctaaaaaatagggctggtaattggagttgctttatgaaaatctcattagcattagcatataactaaaatgcacagctccatagttaattgcaatcctgcactgcggttaacaactacagtgatgacatttgcatattgcacataaaattaaaaatgcatgtcagataggtgctctttcaggaaaaaaaatccttgaataacattgcattcacacaataatcggaaagattttgaatttgaatggaaattatatgtatagtatgagctttagaaagacagccaagcctgataactaaatctgaaacactgcaggcaaagcccccgcagctgggatcttcttcaaggacagggccatggaatactgaactgataccctttgtgtatgcagaaccctttccccagaaagtctctttcccccttgtaggcctcagtgtcttctccggagctttccttgggagctcctcaagctcatgggcttcatcttcttttaaacatttgttctccacaaggctcagcatatagcaggcatttggtgacctgcagatgtgagctgattggagacctctcgaagtgagtcagtcagtagatgtgtgagaggtttcacaaggaagtgaaacacaactcttccctgcacctggagccaggtatctcaactttccagagaccctgtttcctctgtgaagtggtgtttgcctttggagtgtttacgctaaggtgcctagcacagcacagaacctgacacactacaagcgttattcttctgccactgtggcattggggtagcagatttggggaaaggacatgcagaagctgagccatggattgctccacacatatcagtcagtcctcctgtgggcatccaaaggacagaggtgtgtctccctgaatgtaccacccacagaaaggctggtaacttccattccatttcactaagagagatctgaaaagagaggaagagggagggaaagggaggagaagagaagaagggaagggagaggagaggcagatgaaaaaaaaatacctccctggtggctgacacacactgtcagtttgtgttggcagattccctgtgaccctacgtttcctcttgagaggcaactctggatgaaggcaggcatgactagaggggatttctacagcagcttgagagattcattcattcattcattcactcattcatctactggttcacacatttacccactcattcatccagtcaccatcatttggctaatatcatgtcctcagccttgtaacatgcagtgattagaactgtgtgaaccccagatatggagtcagccattttgcacttgggaattctgggatggatggaaacaacccaaaggatcagaactggagatcaaagtctgatgccatcagcacggtgaggagtttgaagcatgagcaggtgggctacctctggctgcttactggggaccactgctacttaggtgctgggaaagaattgatttgctgcttttgaaagaaacagaaaagtgaatgctaggaaagaggagtgtccctgtcctgtggtgggtggcagagatggctctgtgaaaaatcttcagggtcattggatttcacgatatggaggtccttaacagcttctcttcaagagacagtcaagccggctggggaaatgactcagtggataagaggactgctgtgcggagtgcagatgacttgagcttgacccaagcacctgtgggaaaatatgcacatggcagcacacgcctgcaatttctgggggtgggggctggcagaaacagactggttccaggccaagctgaatcagtgagcttcaagtttaataaataaggtcaagaacaacagtggaagacaccaaacatcatcctctgggctccatccacatgctcacacacacgtatgcacacaaacacagagggccataggtaggaaaacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagattcccaaacttcagaactgctgaaaggtaagcctcaggcctctgatttcaagccaggcttccaggacatgttgggaaccactacctcaagtcaaatccaagcctggaattgacccagctctcctgtgagtcagtaactctccaagtttcacagttatatatgtaggcagctgtgccgtaaactctctaggttggatccctgttgtttggcctgaacccaatggctttcttctttgcaggcttaggacaggcctgcctctagcccaggagcacagggtggttaagttgagaggttttacccctgaggccactgtacctctgtcttctgataagctgtggtttgcagaactgtgctccaagcaaagcaacagggattcagtagatacaagaggcatggtaggcacctataaccatgatatgagtgagtgtgtgtgcgcgcgcataggtattttaccttcctctttctgctaagtcttacccttatattcctaacacagggtgttttgtgcctagatagcaccctatttcaggtgactagtctgtgctgatagcaccctcattttcttgctctgaaaagtcacttacagagaactgtctgtagttcttgatgtgccaccaaacttacctgtgttaactgtgtcaagtagctcaaaggccttaggacctaaactgagttcagtgagttatgctcccaggcaagcatgctcagggagggagaggggacacacatacccaacccttgctgctcccatttttcagccttgtttttctttttatcacagaactacctttggacctcagtccctctccattgagagatgttctgttcttttttactggggagatatgaacagacatcttcatgcctctggaaggaaaccaatgccacaccaaagaagagattctacccccatccactgtaataaactaatgagtgtttgggggttccttgcaggagcaggggtaactcaaacacagcagcagcacagaaaagtcccacccccagcaagagtaggaccccatcaaagcagcatcatggaactcttccttctgtcaatcttccaccttctgtctctctaattacacactatgaccacatacagctagagggcagaagggagtgatgggtgagtcctaggtaaaggaccagtgatccaccttccctaactactggggagtgttactcatcccaatactattagacctagctgtcactgtattgttctgcttattttgttgccatggctacaaggccagtgttatctctgctctgtgatgcaatgggatggatggtcatggtatgcctgaagggaaaagccacacagcaggaaaagcttttggttcctgttacttgctcaatgcaggtcataatgtctggtgtgctgagggagtgctgcacgtacaaggcctccttcagctctgcatgagactgtgagagaactgagaggtccctggtcaactgcctagcatgcctgatatggtcaccagaacactgcctctagcttgctgtgagtcaacactgttcaccactctgcttctctttgggttgtagaatggctttttctctaggtataacatgagcatcccatgacattttagagtagatatctctctggtccagtagccatggcaactgattgagcagcatattacagggatagctaggtctatggtaatggtaacagaactactgacacttcctggtagaaggagggggattccagctgtttcttcatcctgtcccctctcagttgcaattgatcctgaaagattggttagtgcaaaaattaactgaaaaggagttctccatgatgttgcttccatgaggccatcatgcatgaagggaaggactttgtggagatgcagctattttagaatcacccaagaccatataagtaactcctcacccatgctctataacaagcctaaataactcactggcttgctatgtaggacttgggtgcaactggtaccttcgttatctctggtgtactatctgggtaatccatgtttgtccatatctcaccaggaaaagtttacatgcttagtgacagcatggagatctccaaagatgccacaatgacctctctgtccacttgataaattgtctaagaaattcatccattccacccttcttccttgccagataaagagctgcatgtcagtcctgttgccaggcctttcccataaatgcttggcctggtgggctgtgctgaggcagacatcattttagccccaataggctggcacacttccaggttccctttgctggcagacacatcttgctgttgaatactggatgtgaatcagagggttgatgaatccttgggcaggttgattgagcatgagcagaccttccacccacaccagagtgcagagtaagcctgacctccatggagtctgtgctgtgttagtgaaggtatgaaactcaattcattttctaccgtatcctcatccctgggctggctgtcagaggcatagagagaatctatgttggtttctgcaggagttatggcccacagcccagcatcttaattggctttagtttgaaaataaatgcttcactggacaatgacacgtctccactctgtttcagaagaaaattttgccttgtgtagactaatgtttaactttaataatcttttcattactcctgaagactgtgttaattattcaaagttgtgcttcatcttttgtgtgtattgttttcccagagcctaagctggtaaacggcctcatccaggctattagataatggctgtctatattgtgagaggtttaaatattctagaaacaaatgagcttctagccttcctgtatcctgacctgtactcttcaaagagaccaaaaaggaatatgctgcagaataaaacactttgctttgctgtaagaagcctaaaaggacttgctggagcctgactacagctgccaagaagctgggaggtgtcttgaagatgtgggggacattgggggcatgctgagtcattctacagcctagggtcatggtttttgtcacccctctaatgagttgttagattgtcgaggtcactgtgagaaacttagtagctagttaggagacagcaagcttaaaggtcagggagattggaccctccctggaaattatcagcttgcagctctagatactgtaattgcaggacaccgactcctgatccaaataatgtctttgagtggccctgagtggagatgtaacattctaaatttcctacagcataagattacttcctgaccagaggctttctggtaaagagcaaaggtatagcattgccccctgccctaagaaagccaatccaagtggggactgtgttgcagctcaattggtagcattcttacctagcatatactaaccctctgtttaatcttcagcatcgcacacagtgaaacatgttcttggaagttggagaccaaaggatgagaagttcgaggtcattcattctagggtacaaagtcagtttgaggccaccctgggctacatgagacccagctctaaaacacaaaaagaataaaagcctacatgaaaatgcaggtctgtttgtctgtctagtgtccttctctggggctggagagatggcttagcagttaggagaccttgctattcttgcagaagacaggagttccattctcagtacccacatgttggctaacaactgtaactccagtaccaggggagccaaccctgtctaacaattctccttgggtactacatgcacatcatgcacagtcacacatgcaggcaaaacatccatccatataaataaataaataaataaataaataaatagttaaggagatgtctacctctgagtagtccctttggccattgagcacctttccttgcaagagtgttttcttctgaggtcccttggatcactctctctctctcatcccttgggtacctaccacttcactttgtaatacactctgtctcttttgtgctctacatgttatatcagaattcactccacagaaatgaaaaggatggaggagcctggaggaagctggcccgagatcctggtaccagtccctgcaacagcccaggcctgtgtctcctgtaggatggagagatcactgtggggaggcctgcaatgagggcagccatgggtccctggataaagagaatgagtagctccctcttggttcttactagaatggagttccgggtgggtttcacacacagacattacagctgtgactgtcggggtcaattcccactggcattgtagaactgggaaatgcatctgttatcacaagttttctgagaattttttttttttgtgcattggtcaaaagtcaaatcattaattgccaaccaataaagacagagccattgggaaagataattatcaagaattctaattgccctggaattctatgtagaaaattttatatgctgttgtatctgagacagctgaaaactctgagaaactggaaactctttagccaaaccagattgtgatttttttcattaaaaagatgtattttatttcatgcatgtgggaattttgcctgcatgtatgtaagtagtgtgccaggtgcctgtggaggtcagaagaaggcatcgagtcccctggaactggcgttatagatgagtgtgagtcaccatgagggtgctgggaattgagcccaggttccctggaagagcagccagtgctctaaccactcgacccatctctccagctccagttaggtttctttagcattctctagatgtggccaagtgcctgggactagttcataagtcagttatagaaagatttgttctgtttactcttagctggattgcagaaaaaatgaaatatatatagaatgtttaatcacagggtgctaaattattttcaaaggcataaactttatgttctagtgaaaggtatcaattagtatacagaatacaaaaatattttctaggtataaagacattttatgcttagtgtatgcagactacagcttaaaggtattaagttactaaattaaaggaaaaaacaagtccaaggcaaaggttgtagctcggttggtgagtgcttgcttagtatgtgcaagtccccaccattgcaaaatccaggtgtggtgacatacacctgtaatcccagcactcaggagatagaggcatgagaatcagaagaagctcagggtcatccttggctccatctttaccaaattcaaagagagcctgttccaaacaaacaaaaggagtgaatgaaccaagaaacaaaacaacaaaaatgttgtccaatcatgcaaaaaggccagcagcttgagggtagaataagaggtgattttttttgttgtttgttttgttttcatgcagcctgggatttccctnnnnnnnnnnnnnnnnnnnnnnnnnnnnnnnnnnnnnnnnnnnnnnnnnnnnnnnnnnnnnnaaccactggagtacagtggagattcttttcttatttttaacgtttacatttttaaaattagcatacaaggtattagatctcattggggcactctcaaacaaagcatactatattgattctttgcccctaatctctctcctacgcccagttactctactctccccttgttacccttcctcggtctcttcaatcagaatttccatgtgtgcattaataactctttggaggacagcgagatggttcatcaggcaaaggtgacctgagatcagtcccaggaactcaagtaaagatggaaggcaagcactggctccacaagttgtcctctgaccactacacatgcactgtaatgcacacacatacacattatccatataaacacacatgcactgtaatgcacacacatacacattatccatacaaataaacatttaaaataataaatacttaaataacaatataaaatataaaactatagaatacatttttagattggcattcagagttattttataggtcccatacggttttggttatagataaatgtgaacaataaaggaacagagagagaaaacaaacaacttactatagttgaacttatgatttcttagtttcaccatgaggcaaaaatgatgtgtaggaaagcctatattttgcatctgacctttttgaactagtactatgtagaacaatactgtctcacgatgctggacagagacagtgaaccagtgggtcccaagtctgccatgtgatcacgaaggcaaacggaatacttcatgatgtattgctaaatgatgttaggaagcatggtgcttcatttaagcttgactgatagtactaattgatttacaacgttctgttggaacataattccattaaaagttaaggaatatcgtgtgtgtgtgtgtgtgtgtgtgtgtgtgtgtgtgtgtgtgtgtagaggcagaattgtagagaaaagaaagatcgcaaagttgtggtctgactcggaccaaagattacaacatgtatggcatcagagactggctttgattttcatttaaatcccaaatctatttcagacaaagagataggtaaaatatttcataacacagggtgaggagttttggatgaggaatgtgcccataggctcatgtatttgaatactcagttctcagttgctggcacttttaggggaggttatggaactgttaggaagcacatggcaggaagtcctccctgcctgctgcactctctatccctccagagctgtaagtcaaatacctcttttcttctttaagttgcacttggtaaagtaactgatacccgggggtgtgacaaagcatacctatcttggtacatgctggcttcacaatgggatgctaggagagatggtgacatagatgtgtggaagtcaccattgccttccacattacctttttccttgctgtgacaaaatccccaacaaaggtaacttaaggaatggtcgttttggctcacagtttgagggcaccgtgtcaggagtgtgaggcagctggatgcactgcatctgcagccaagaagtgaagagtgatgaaagctagtgctcagctcactttcttccttgtatgccttccagaagcccagcttacaggatggtgccgcccacatttagtttaattaacctaattaggtcaggttagtgagtcaagaaattacttctctggctttcccagaaatttgtctcctaggtgatcctagatcccataaagctgacaattgatattcaccatcatgccttccaaaactgtggtggcaggaaagagatctgagcctttggcttcctatccaagaccatatgttaattcattcactctttcgataaaattaactgagtgtctattatgccacgatagtcttggaaatagtctgtgttgcaatgtgtgacagattagtattaattgttaaattagcagcagaatcagattattgatcaatatgagcaataaagggtagctcagagctctccctcaggcatgctatataacctaattatataggaagtaaagtggtgatgaacttgtccatctgggcaggtggatactatcaaattgccactgtgtatcttggatgatgactaggtaaagaagtccacccaaaaagtacaagccttcaaaacaaaggagccttcctttggggatacagacaaaagtggatctgtttatagagggcttcgagcaggaaagggcttgacatcatgatcagagggtcatgagtttatgagattcataaggaggtgagcttatgattcagaagttcagagtcagaacaatctaaacaacctggccttagctcagcagatgtttcctatgagtcatttaagatgccttaaaaaaaaatcaagcaactagatggaaggcttacagatgtgagttaattaactgcacacaagcaacacaaaagcaggggttctgatatggaccatgcaaaggaaaacacgtcacgagctaagaggagctcttagagacgctctcagggttatggcctcataaatactttgcttgtactctttggaactaagtaaagtggagatggctttaaaattgaaggattttttaaaatgcaaaagccaagctgatcaagagatcacaaaagtgtatcataagtgaatgccctgcagctaacatacaatttgaaaagaggaagcaataagtaggaattgacatgatagtctgatatgtaacaaaatagacatcaaccggatattttgtatttatcatacttaattaaagcggggccaaaccaaatgggtttactggaggtttagggtctagtgacagtagtcaaggggtagagagagagaacacacttcaggctctcaaggatagggggctgtttcattacagactatacctaatcatccagctatttctgttacagtacaatgcagcttcactgcactgtggggacagtccacaccacccccactatgagtgtcttgtgaagtgtgtgtgtgtgtgtgtgtgtgtgtgattgtgattatttatattttggctaagactatctctgtttagctattctatttcccactctaaatattggatgcatgtccaagaagtcaatttaccaaatacacttacaacagaaacaaacagtggtacatggtggagggtatggagcaactgtatgaatgtattcctactacaaacactgttgatattatgaataaataatagggtgcgtatatttgtactggtcttttatgtacatgtaagtactacggtgattaatagactatttcagagcatttctgggtttatagcttttaccattatgtttttcactaaactgaatactaaaagtataattagcataaaatgcagaatcctcaaaaattattgacattagaaaggcattctcaaacctattgctggaaaaattgagttgttaaaggtggaacaacctccttgagattaaatatttcctatcttttcctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaggaatattttatgattttatagatcatactgcatctgtttccacaaaaattacatgcctacattcaattgtgtaacccttaaataggggaaattataatcctatcaaattgagaatatataatcctttaaaaacacattttagatgtaagccatatgttaaagtgagtggatcaggtgttgaaataacgtgttttactttcaaatacattacccctgtgtttttaaagttacagaggataagtagcagcctgagtgtgctgggataaacgatcacgctcattgtcctgttgccggaggatgttgttttgacagctgcactttggccaacagtaacctgacagaatgtggataatgaaatgtatgatggttaactgattgtcagcttggcagagtctccaatcacataggaaataaagctctgtctttcttgtctgtcaaggactttctaggttggcttaactgaggtgggaagacccaccctaaatgcgggtggcatgattccatgggctggcttcccagaccagaaaaaaaaaggagaaagtgggctgagttccagcatccattgtccctgattcctcactgaggaagcaatgtgaccaactgcctccccttctgccaccatgcctttcctgctgtgatggactgtgccctcaaactgtgcattaaagtgcattctttccttgggttgcctttgctatggcaattacaaaagcaagaagtcaccttcaatgacagcaaggagcttgccttcagcctaagtgtagtgtcagcaatctttgcatccatgggcaccacttctggtcccagtttggggggtagacttgtccaggtcaaatgcttgggtgtgttcctagctccaagggtacatctttttttccccttggaccactgaagattcttttcatcaagtttaatctgtatccttcttctttttcctctcaccaggttcattcactcatgcatacatgcatagataaaaacattgtttctcatatgccaggtgctgtgctaaatgctgcagatacaatggtaagcaaggagggcagaacaaataggtacatgggagagatataataaatgacatgtgctgtgaaggcaagagtaaaagccatgctgatatgatatgatgaatcctgaactcagatggggagttaggactgctgactgcaagaagcctgccttgaagagccaaagctacatgggccataatggcagctggtaagcttgtgttactacttaaactcatattgattcatttcctcaaggttacttttcatggttagatgctgttgctcccagaagtcatgggcttttaaacaagagcccaagtaccaggttgtagcatgaataataaaaaaacagatatcagggttcaagctgaagatcagaaaagcaaagcagccagtcaaactgaaggggcaatccaccaaacctcagactgcttagactgttctccactagacctcagactgcaaagagttcctgtctcctcccaccttatattctctccacccagccatatcactcctgtctccaccttcctaagtgctgggatcaaaggtgtgagctcactttctcttttagactaatttactctcatgtagcccaggatggccttgaactcacagagacccatctgtctctgtctcctgagtgctgggattaaaggtgtgtatcaccactgcctggcctctatggctgtagccagctttgcactttgatcttgaggaacacttcattagatcgtaaacaaaatatcaccacaccagctgtgggatacctctctatgaacagttggccagaaagatcttagaggcccttaaaagaatacaggctactggggctgaagacaaggctcagcagttaagaacattggctgatcttccagaagacctgagttcagctcctgacacttgaatgcatgcctctcaactgcattaactctaatttcaggggatctaatatgctcatctggcctccataggcatgtgtggcatgcacataagtgcagaagcatgtacccatgcatgtgtgcatgtgcacgtgcacgcacgtgcgaacacacacacacacacagacacacacacacacaaacaaaaataaaaatctttttaaaaaatacaagctgctgtccttgcttctgggagcactgcagtattaggtggctgtcattgctgtcaaacatgttgctgacacaacatgtgctctgagcatagggcacagagaaactcagttggaacactgttggaaactccctcctgatggctagctcttgtagtgttggaaggtgctatgcaggctgccgggggagagaactcataatggtctcaaccatgtatgctacttaccctgctgggcaaaatatgtccactggtgcaatagagacttgactgttttgaggatttgtgattggatttgagacctgatactcaggaggaaatgcgtacctgatactgtaaacctggctggggagagcatgggccaagagtcatactctcattgtttccctaaatgaacttgtcattaaactgtgttctaatgtttttgtttatacctgtagacccacgatgctcttgacctggggcagaggggctctttttagtagaatgtgacagctacagcatggactcctacatggtcaaaatatggagaataagtgaccaatgagtcctcagccttaaataggataataggattcactctctctctctctctctctctctctctctctctctctctctnnnnnnnnnnnnnnnnnnnnnnnnnnnnnnnnnnnnnnnnnnnnnnnctctctctctctcacacacacacacacacacacacacacacacacacacggaccagcaaacactgcaggggaggggcaggaaaaacattaagggctggaagatgggttagagtgtcaggaactgctgccgtgcagatctgatattgctgttgaaaccatgagcacatggctgctgtggatatctgcacaagacaggcccacacgaggtccacctctgctgaggaactaaaggttattaatggtctctagggcggggtgtgttctttaatgaaatagtcactgggaggctaggtaggtaggagaaagaggttcaaggaaaaaggaaaagctgatactagagggtaatgtgggccatataattataacatacttgttatatgtatgcaattgtcaaaatattcaaataaaaaaatcagtttgtgccacgagtccacgttcaagtatccaacagctatgtgtggctgctgtatacagggcagcaatagtgagtgcctcactgcctggtgatcccacgggtgcaaatgcacacagcctgtgtcatggaagagacagattgcaaagctctaaaaacaatcatacaaacagcaaatcagctcagagatgagagcttgcaggtgagaatgcttataaaggaatgttcacaaatggattggcattggactcaagggagaggaccccaaagcacaacagagtgagtatggaaatggaaacggaggaaagaagacacaatccctttttgagacaagatgccatgtatccaggctagtcttgaattctatatgtagccaagggtgaccctgaatttctgatattcctnnnnnnnnnnnnnnnnnncttctacctcccagcattgggatcagaggtaccatattagtccagttcatagggcactcaagattggacacagggcttcattcatgctagtgaaactctctaccaactgagctacactgccagctaagaatatctaatcttgccgggcgttggtggcacacacctttaatcccagcactcgggaggcagaggcgggcggatctctgtgagtttgaggccagcctggtctccagagagagtgccaggataggctccaaagctacacagagatacattgtctcgaaaaaccaaaaaaaaatgtctaatcttaaaaaaaaaattaatcagtcaagatgatgagcaactgaaaatccaagctctcaggacttctagaaagaacaattactatgagtgtgaggccagcctggactacccagtgaattctaggccagcctgagaccctgtctcaaaaatccaaaaacaaacaagacagaaattaaagcaaaagaacaacaaaacacatttaagataccaccatagattaaactaagcaagtcacaaattgcactatcatgctttatcttcaaacctgtgtgagaaaagccccagaggagggccacaggagaactgtacaaaggaacaagccagattccaggtagagcaggaggctgacagtagatcaagtgtatgggatatacagcaaggctcctgaaggtatggaggacttgcaccagtggagagaacgaggggcttggtcaggcagcactgggattaatcagactggaggactggtgcctgaaggagtttagacttaggcattaactgatgaacaatagattgacagcttgagagtggttagtgggctcactagacccatggtatgaatgttccttcaagctcacacaccattgagccagaagtggcagcttcatgtagtgttggtctcaagggctttggcttcaacgcctgctggctctctcaggataggtagagagagggatcctacatgaggtgctgagaacctcaaagcccgggtattaattagtccagtctcagagactgtggtgttggcaaccctataaacgatatctccattgtcaaacagcctggggcaggtgggtcccaggatgtgaacttttccagctatcctgcatatagcatattctcttgatgtaaccactcagctcggcaacgaaagagccctgtgtacatcccgaatttttaattgtgaaaacttgttagagttgcacgttacagctgtttttaaatttagtcctaacaaaatacagcaagaggttctgtcacaagattaattatttgagaggttatttattatttcagttatgtgactttttcccactgacaaaagcaatcaaggagattaaaatggaatcaacaaaaatgaacggactgcctaagtcccaagtgtcattgaaaacatgtcatatacttattaaagttcctacaaaatgggttagtgaggcactcacagtggccaccgtcccaggttcataatctgactgtcaatactcacaataatagccatcaaccattaagcccgcttacttacagatgtggaaactcagcatttacagtgactttaatctctactgacatgtcacccgagacttagcccagagaatggcaataatactacaagctttaaatctcccatgttagagaattgtggatcttaatgctttacgatcaagttgtatggcccagtgttggaggtctcttcacaacagcccagcagatggcttccagcttcttgaccacctaccctgagtgaatttggatgttcaacagtctagggtacagaagctgctatagtgggaaaggtttgcaaggtgacacatatgaaacctgaccacagtgtgctcctctctaggctgagaccagcaagtgttggtccgtttacaattaggcttactctagccctcttccttcccagcaaatgtatctgcaactgtcagaattagatgcctcgtgctgggcaaaggtgaagtgttgaaggggacagaagactgtgtgctggggctaattactggagcttaaggaattagggttgactgcaggtcatcaagcatgagcttctcaatctttggagcccacatatcctcattagtcttgaacagcaaccagaggactttccataaagtataaaccgtagttctggagctccagagccgttccctggcacagctgaaagctgtaaattgttaagagaatcgacgctgctgaaaacagatcagaagttgttaaatgaaggagacgtcaggagccagtacagtaagactgtaaagactgtgatcggaggccctggagggatggctccgtggttaggagtgattgttgcccttgaagaagatgcaccccacctccatttgggcccaggacccacatcatcaggtggctcatgactgcttgtgactccagctccagggtatcctgtgtccttttcagccactgtggacaactgaacacagataggtgtaaatatacataattaaaaagcaaaataaactttttttttaaataaaagactgtgtggtctgaggtgcataagataatatcaaaatctatgatggtgtgttggactaagatacaataaaattcaaaacactacagctttgtcattttttaaatgtgatggagccattggtagtccattactataatcccagtactcagaagatggaagcaggaggattgggaacttcagaccaacctccgctacataggaagctggaggccagcctgatctatatagtgaaaatctgcctcaaagtacaaatggaatgaatagacagttctcaaaagagaatatataaatcgccaaaaaatacaagcaaaaaatgctcaacatcttcagccctcagagaaatgcaaatcaaaactatattgagattccatctcatccctgtcacaatgactagtgccaaggaaacaaacactggtgagaatggaggacacagcccttagaaactacttgtgggaatgtatatgtactgtatgtgtggctagagatggggaggggcatgggatgtggaggacacagcccttagaaactacttgtgggaattaataacagagcagtcattgtggaaataaatacagggatacaaagtgtcctcaaaccctaagagagacagacatgcatggtccctccgagaagggcaaagggacaagatctcctgagaaaattgggagcctgggggaggggagagagagttaggaaaaagagaaggaaagaagaggaggagtgaggaagacatgaggggccaggaagaatgaatcatggaagaatagaggagagcaatataagacataccttaatagagggagccattataagtttaaagagaaatctggcactaggaaaatgtccagagatctaaaaggatgaccccaactaagattctaagcaatagtgaagaggctaccttacatgctcttcccctataatgagattgatgactatcttatatgtcatcctagagcctttatctagtagctgatggaagcagaagcagacacccacagttaaacactgatctgaactcctgaaatccagttgcagagagggaggagtgatgagcaaaggggtcaagaccaggctggagaatcccacaggaacagctgacctgaacaaggggagctcatggacaccagactgataactgggaaaccaacataggaccaacccagaccccctgaacgtgggtgtcagtgaggagacctgggcagtctatggggcctctgatagtggaacagtatttgtccctagtacacaaatggacactgggagtccattccccatggaggtatactctctcagcttagacacatgggggagggcctaggccctgccccaaatgaggtgacagattttgatgatccccatagaaggcctcaccctttctttgtcgcagaagagggatgggatgggggtcggtggggggcatgggagaatgggagggagagagaactgggattgatatataaaataatattgtttccaatttaaataaaaaatataaaaaaaacccaaaagtcctcaaaaacaaaattaaactcaacaaccaagtgatcccctttataccactcccgggtgtatccctgaaggaatctaaatcctacaccagagacgggtgtgcatcgtgtttaccgatgtgctatccacaatagcagataagcagctggcctagatgcccatctgcagagggtaaagaaacgcctatatacacagcatatatacagtggagttttattcagtcatgaagaatgactcatgtcacttgaaggaaaatggggagaactggagatcattgtgttaagccaaattgttcagacccagaaagacaaatactgtgtgttttctctcatttgcagaatccagatttgtactatatcatctgcaagtagaagggtgaacaatatgggaggaagaatagggaccagcaataacggggcaaatatgagcaaaatacaatcatattatacatgtgtatgtatggtatgtataaaatgtcataatgaaaccattgttttgcatgctaactataaaaataaattacgaagagaaaaactttgagttggggatgtagctcagtgatagagtatttgcttaacatgcccgaggctgtgggatctagtcccagcaccacaaaacaaaataacaacaataatagaattgttaattcttttttgatttgaattagaaacaagattgttttacatgtcaatcccagttccttctcccccccctcctcccctaccactcccagccccaaatagaaccctacctatcacatagcctttctgctccccctggatggtgagaccttccatagggtgtcatcagagtctatcatatcctttgggatagggcctaggcccactcccatgtgtcttggctcaggaagtattcctctatgtggaatgggctcccaaagtccacacctatgctagggataagtactgaactactgatggggaatgtactgtgtatgtttatcttattgattgttaaataaaatactttttggccaatgagacagcaagtagatgggacctaggagtcaaagaggattctgggaaatgtattagagaagtgctgatccgggcaggaagtgacatagcaaggagactcatatttgagcgaggagaaacaggaagttccctctttccccttcgcctcctccagcagcaggatgtgatccaccagcaaggagggatgccaataaggcatctgataagataagtcttataaaatatataggtttatgatagttaagactgagttagcagatgagaagtcctagtcattggccaagcagctttgaacctaatacaagtttctgtgtattcatttgggccctaactcaggcgggcggttggcgtaaagctcacacgtggtggtggggctcaggcaactttggcagaaagatttatcgtaacaaactactaaggacatcccgtagatttccgaggtttcctcactgaaacctacgttccttctggggtcaggatcagtcccatgctggtatcccagctatcagtctgggagagctgttaattcttatgaaacttcacttttaagaaataatctcttcaaatattaaaatttcaggaggtcgctgacacagaaaaatattcttagtaaaattgaatactatttgggaaaaccatgtataacttattgtcaatagagaggtaaacagatctctgagagttcgaggccagcctagtaacagcctagaaatagccagggctgttacacagagaaaccctgtctcaaaaaatatgaatttctttgatttttaattttaattataatcctggaaggaattcttttctttatctctagaaaacctaatatatgtgtggcaattatttaagtacccactaatgtatttgttcccatggattcaaagtgtaaaattacttattttctagacagagaggcagatgaatacacatatttatctgacaaatttagacccactaaagctttactgatagtgatgtttcttcggagactgatttaccaacagacagaagtatttttaaaacatagtctcggaaatcagagacaaatggatttgaaatggagttttgtttcttacaaattgctttgcgtctggtgggattttcaaattctgactctaatgagatttggctccatgtaaattctctgttaaaaggcctgggccggtgtagtcctatagacatttattctcccacacattacatgccattttagctgatgaggggtggagacaaacagatcctattcattagactgcccatgggaagagaggtctatgaaaacagctttttgaagcatttgccatttgtttgctagaatgatagcaatgttatacttaagaagtgtgtgtttgtctatgttaaaattaaatctggtaattagtttacttagacaatgaccactcaatttacttagaatccactacataccaggcatcttgccaagtgttgcagaggatatacagttgaagaagttccctgtctaccccaaggttggtgaagcccatagtcaagaagtaattgtggaactgcatgtttaaaagaacatatgaaatgatattgcgacatgttacactgtaacacaaaagactaaaaccaaagttcttagtgagtgaagactttgaaactatgtacattgaaccttacagaaatttatgaaaattaattttgaaaaataagctagaggctcagtggttaagagtatgtaccggtcttgcagaggatctgtgttcaggtcccggcacagaggatgggcagctcacaaccccctgggactgcagctcctatgaggcctgatatcctcttctagactctaagggtaccagcactcatgtatatagccagatacacacacacacacacacacacacacacacacacacacacacacacacacacaccatacacacacacacaaataaatctttcaaaatattataaaaacataagatacatttgactgattcttccccaaacctcttaattttcatttctaattgaacacgaccatattgtttctctttcttgctttatgagcacctcaacttttactggcgtctttctgagtcgggcagaggcagttatgaactccaagccagcctacacagtgaggctttttccccccctaagatttgtttttagggaattgcatggaaacgatcattttcagatgggccttgaaggacatgaggagtttctgaggacttgagaagccaggtaactccctaagccttagaatctgcaggtgtgacaagagggaggagtgaggagtgctctgcctgggggggtggatggcatcgagcgggctgctggaaagggagtgggaaatggtagcagatacaaccaggagggatcagagtcagcctgtcctgggtggaaaagtcatagatagatgataggtagatgatagatgtgtatattacatatgtgtaaatacttatatacatatataacatttttttctataccatttggaagtaaattgaatacatggtcataaccttcttttccaataactgggactgtttcccttataaccttgttgtctattctgaagtttatgtgccaatgctggcatgtaaggttaatgtcttttacagcagccagtggcttgctgctcttacttgtcttgttcatctgcgactgagatgtagagcatccctacagcattgcccccgacttccacaacacggaccacatacatagttttaaactttatctctgtagcttatgtgaatgtgtgtgcctgtgtgagtttatgtgcaccatgtgcatgcagatgcccacagaggccatggggtgctagacacactgaagctggagtgacaaacagctttgggctgcctactgtgggtgcacagaaccaaacctggatcctctgcaagagcagcaagtgctcttaactgctgagctgtccctccagtcacaacatcgactttttaaaataatacattccacccacttttctttttattgataaagaagttcttattttactttagaggctttaaaaaggggataatgtactcagatatgcagtttagaaaaaaatcaccctcgagacggcatatggtggagtgaaagtaagtgactgttgataaggatgtgagctaggagtccactgttgggcactgttcccttttgggaaggtggaagaacagggtttgggaagctgaggcaggtacaggaatggaggagaagggcattggtcctgggtaagactgccttaaaacggaagggaagagttctcgatgctactgcctgtgaggctggtagagacccgtggctttcagaggacggtgtaaagtgtaaagacagattgcagcttctcctggtggggggagggtaaaatgtgtggcagagaccacagtaaaggcaaacaaaccccaatgtgggaagttacgagagaaggaagactcaaatattgggctagtttggttcatgactggaacccagaggcccttgtgttaagagagtcttcaggggatactgtagagtctagtctagtctagagggtgattactggtgttcaacatgtgagtctgcagtgtggtcttcagatcactttagggagaacaaaaccttgaaggggaaggtaggaccccagccatgtccttctcctctcatgtttgtatgccacccnnnnnnnnnnnntccccgctgaggggtatagcgtcactttaggtttaaaacactgaagccgattgataccttctggagcccaagccgggataagctttttcttgtaggaaggtgattgtcttgggtgttttgttatgataacagaaactgacacattaggcatggactggcagtcaagggaactttctgctcttggtgtccatgaaagccatgtgaatgcaggaagtttggctttgtattctagtaaaggaaaggactggaatgtatccaggcatggagccaggatcagtgatggttttgcctctccgccccccaaccccctcccaaacaaaacaacctaggattctgggaaatgataatctttggaggggtcacagtggcacttatatatgtttgagtttaaatttatactgactgaatggttcaggaatattttccctgaaaataaacaccaaaagaaggcagcgatgacccacatggatctgataaaagtggatgaaaaactgcttcgggaggatgtagcctcatcataatccacataagattcccacagactgaaatgtgctgggcatgaactcaaacaaaaactataaaaacacggaaaagggagatctgttctaagtagatatttgcaaagacaaaaccaacaaaaaacaaacaaacaaacaaacaacaacaacaacaaattcctgataacttcaaacagtagaactaccaccttcagactttaaaacaaagcggagggcccacagatggctcagtgggtagaagtgctcactggcaagcctgtggacctgaacttgatgcttaagatccacatggcaaaaggagacagctggctccatgagaatcaccctctgtcctctctatgtgcctcagctcatgcaaggtacaataaatttggatttaaacaaacctaatgactaacttagttctgaactacacaaagcaaaagtggacaaagttgcaaggcaggagggagggcaggagctgtgccatcagagtggcactcaacttgaaaaatgaattaactgtctctgaacctttctcattggtgtttgcacatcattttagttacccctgagtagtggcaatcatggaaagtaaaccacagattggagctgggttgagcactgtggccgcaaaccttccagttcaggatgttgaaggcattggcataactgcgcagtaaccctggaatgagagattacagagggaagagagaggagaaaccaatgagaaactgctggggcttcccacgtgcaaagcggaagagagggtctcccaagaagtcagagagcattcagctcaagggacaacaggaaatggctgcagctggattcttcgtggcaacttcagcttctcactatttatttggcacaaaatgagtatcctgatatatttaaatgttttatttcttgaatcttatttgtgtgtgagcgtgtacgtggtgtgtgtatgtttgtgtgtgtgtgtgtgtgtgtgtgtgtgtgtgtgtgtgcagtgtgttcatgtgtgcatgcaaatgtctgtgcccacgttcccatttggaggccaaagtggggtgactaatggtccactctgccactctgttttgttcccttaagacatggctttccactgcacctagagctggactggcagccactacaccccagcaatctccacagtgctcatggttacaagctcatgggaagctgtaccagcacactgggggtttgaacttggatcctcatgcttacacagcaagtactcttgctcaatataccacctcattagcctcagagattactttttaaaaatactgtatgtacttttttttctcatgcatacttggttgatctcaatccccttacaagtgctggaattataagcatgtgtcaccatgcttgatttagctggggctgaaatcaactccaaggctttgtgaggatgaggcaaacactccactagctgaactacacccctacttcatgctcatgtaaacatcatcatatatcatcataatcctgtctctcttgattctttgaaatcccatgctgatttttaccccacagactgtcctgttgctaactggattattaaaatttaaaaatatgaaaatctgtcaccatgtctctttgaaatactgacaacaacctatctagctacttctcattctcctgctctcactatctcctctcaccctatgtcactgctgttcttggtggggcttgttttgttttgtttattattctatgtttatgtatacccatggtcctagttacttttcctaatgctgtaataaaacacaagcaacgtagggaaacagggtttactttggttcacattcaagagtccagtccatcatggcaggcaggtcctggtaccacgagctggaagcagctggtcacattgcatctgcaattgggaagcaaagaacaatgaatgctggactggctttcttcttcctgtgtggtctgagaaggaccccaggccgtggaatggtgctgctcacaatggtgttgggccttgcttcctcaattggtattctcccacaggcatgcccagaggctcctctcctaggtgtcattagaacccattgggttgacaatatgaacttttgcacccgaattcttattttgttttcattaagtggtgatttatgctttaacttgtcattgaaaattgctttctcacatatatattactaagactgttgcatttagctattagtatatttttattgctttataatattccatatatgttaatgttaaactttgctttcctaccaattgtttttaagatggtttctaaatgattgaacctcatgaactaccatgagcttaaaacaagaggacctccttactgctgttgcatggtcattaatttatattgatttcaaacattttctgtgatccaaagctcataaacaagatgatgctgggtgaattttctgattgtggaaattgaagtatatattttaattttaaaaattattgttttaatcccagcacttgggaggcagagttaagtgggtctctgtgagtcccaggacagcatctactacacagtgagtcccagatcagccaggactccatggtaaaaccctatctgaaaaatacatattattgttgtgtatatgatgagtgtcactcatgtgaaggccagaagcaacttttagaaattgggtctctcaacttgtttctgatgcagaattgtgtttctcccatctccatccaccattttactgtagctgtgctgggattgtgtgcacacccaccattgcatctggctttttttaagggagttctgatgatcaaatgcaggtcatcagtcttgcaaatgcttttacccaccgagttagctcccaatgacctagaaaatgacgtctaaatcaacctcttcccgtaagggtagataccatctttggaatcgtgtataatgtggctctagataagggatactaagcaaatgtttgcttacaggcaaaatcatgacggtgttggtgacatattttcccctgatccagtttcatgtcagtgtcattttcaagagacataagtaacactgagggctagaggaaaggagatgaggttataggttaaccaacagagagggacagctcagcagccaacactgagaatcctcctcgtgtctttagagagtcctcaatgcctttctagaggccctccttgcagtaagagggtgaaagatctcaacagaactaagtattctactgggcagcggaggcacacacctttaatcccagcactccagaggcagtggctgtaaactagaggccagctggtctatagagctagttctggaatagccaaggccaccaaaagaaaccctgtctcacaacaaaacaacaatgacagcaaaaaagaattaaccaagggaaaaacatcctgtcagatttaaactagttgagagtcagtcaagaagttttgcacactcaataggttctgagcctgaaccataagagagatgccttctctgctgggaaattgtgagtgtgtgtgtgtgtgtgtgtgtgtgtgtgtgtgtgtgtgtgtgtgcatgtgttcatgggcctctgtgtgtgtgaactcatgtgtgtgcatgggccaattagtgtgtgtgtgtgcgtgtgtgtgtgtgtgtgtgtgtgtgtgtgtgtacatggggaaaccctacattggacacatatacaagctatgttgctactctttgcatcttatcttctattttgctggactgtcaccaacatcttttcatttacataaaaactgttactaaacctgttgctaaattgctccatttttcactcttcaataaattcacctagaaacaatgtaattttaaaaatagttatttttatttcatgtatgggtgccacatccatgcctggtacccagaagaaggtgtcagatgtcctggaactggagttacagacagttgctagccaccatgtgggtcctgggaaccaaacccaggtactctggaagagcagtcagtgctcttaaccgctaagccatcattccagccctacaatgtgatttttgttcttgccaaaccactctgttttctgccaatcaaactgtctctgttgctcacgacaagactccctccctctttcacactcacctcacaaggtcttgtgactgaaggaaatttttggaagcctattacttctggacagacattagggctctcaaagggctaaagtgtaatctgccaacatggaccacacgttcttgcaatgacactgtaagacagacttcagggctggctctctgattctagcttttggtcattcatgctgaaccccctttatttccagggatgtgggctttttaaagagttaaacagaatacacatgccatgcttttagatggaacatggcgcctcacagtaacaagtttcccatacctgcatatgaaacacatagagaaagtattgtttctgaattttgccatttatgcagagacatttaaatctggagggaaacagcaggtgtttcctccttgcttgggtagaactttaaggcaaagcaagggaccacagctctgtcttctcgacagatcaaacgaagatgcatctttgctgaccccaaaaagttctggctgcacttccaggtacatttctgtggagttaatgcaactcaaaaattcttcatgtaacccctacttagcatttatctaaacgtaatatgaatatttaaggtctttagactcagatctataagatataatggccattgcctgtttactcatgtccagcttctcataataaaatattaaaatttgccagtaaatacatagacagtagaaagatgagtttatgctctgaccaagcattgtggcctcactgtaaattaccacgacaatttttctttagataaagaaaactcctatcttatgaagacattgatgacaacttgaaattgcttttcacttaccctcttccagagccaaggagagagcagagaaaatgtgtgccatgggaaagctgtattccccttctctttctcttcttgggaatagctttctaaaaggtgaagtgtgcacaacacgagatctggggaacaattcagtgccatggccaccaggattccaacaagggcagcagctgccgctttaaaaaacataaagcaaattccaatgcaatgaacaacttcgctgatcataataaaattaaacaagatgcaatattaatagccatatgagtatgagggaaatcctatgtctgttccttttcagacaaaacagaaatgcaaaacaatgttataaacagatgagcttccatgcatggtcggccagatggcatgtaggtaaaggtccttgccattaaacctgagttcaatcactgagaacaacatggtagaaggagaaaactgtgtcgtgcaagttgtcctctaacctccacacacatgctgccatgttgcgcgcgcgcgcgcgcgcgcacacacacacacacacacacacacacacacacacacacacacacacgttaaaaagaatccaagtagtgatacatgtagttacctcttgcccctagaaaactcagagctttctaggatctgtattaagaggtacaagtattatttgcccattgcttttatcagtgggggtcactgacaggacaaatggacacacaggagtaacaagttactctgttgagcagacacttgtatgtggaattcccaggatttcctgtttgctttgcacttcctcatgagcttccatcactttcctacttggcaccatccctcacccagacattgtccaaatgattgttgtcagttattgtttatacaagccagcaacttcctgctggaaggcaaagcaatgctgcctattgctcaaagttaggaacagcattcttttctcatcttcttctacacctataaagcaagcttttactgtagaccctagttagcatagccatccacagaaaagattggaacaaatgaaacatttggaattagaaaacattaaggaattaaaagttacaggaggcgatcatagtactactagggaaaattcaaacactttcacatgctattttaaaacaaataaacatattgagtgtgttaaaataactgtcagcaatatggaattcagattcatcaaagcaaagccagttgtcctgtgatgtacagcataggtttgcattgcaaatggtattgcctggtaaaacagaaagagctcagcaaacccagataggaatttcctgtctgtcactgattggttactgtctttcatcaggtactcttcctgtagtttcagtactttcccacaagacaagggtacctaactgtgtgggccattggtaagggcacagctctagcagaaagtgtctaaagcagatccggacatgcaggagcttaatggaaaattgcttctgttgtctgtgttactttctatctgagcacatgactttcccagttaagccttctgagacagatagaagagcccctttacactatgaatagtgaagaaacagctggagtggtagggcaatgtagagagcttgcctaatactcatttagtcctgggtatatcagtaccatataaaccccttatggtggtgcacacctgtaatcttagcccttgagaggtagaggcaggaggatcagaagttcaaggttatccttagctatatgtaagtttgaggctagtctgacctaaatgagaacttgatttttttttaagtaaagaaaaataataaaatggctgaaatccagaggctgcttttgaaccaaagcactcaaaactctttcctttatcttttaggtagcacaactgttagcgaggacatccaggttcaggtgcaggagcctgaccaaaatcagtgtttggcagcatcctactttcaccagctgccccaggctcagtggctgaggaaacttcaccacaagaaaatggcagaagcagcagggtaaatgcatttggaactgtatgccatcagagaggttcaaaccatgcagtccagtacaccagtcacatcacatggaagggttcaagaagctctgaggctagcaatgtggctagaggctgaaagtttgacaatctgagttcaatacctggaatccatatgtggaaagagaagtgagtcctacaagttgccctctgatccctacacatatactattctctctctctctctctctctctctctctctctctctctctctctcccaaccggtgggactccacaagaaatcatggaaataccaatttttttttttttggtgtcagaaatttttcacaacagacatacacacacacacacacacacacacacacacacacacacaccataaatacaatgtattaaaaaaaaataaagaagtttgaaaaatgagcaatttatatggaaacaaaacattgggcaaagatgtgtgcccctctgataaaaataactttacacactttgtcctgaatccgcccagtggtgtctgccactcccagcttctctcaagttctcgaaacagctgatctcttagtggttttagaagtgtcagtatctcaggccctccatcttcccctggacagcaatcctttctcttctagtgctcattccccagttcccctcctacctcctactgacagtttgtctaggattttcttctccatccttcctgtgtggccacatgactggtagatgcttatcagggtcaacaggccaggatagcaggcaagcagtcatgtgacctggtcccagcagctttgaagctaccacgcctaagatttccatgacgcacctgctgccgtcacactgactcccttgtacacactcaaatcttttccgaaagtgattttaacaaagaacactttaagtcaccaaagaattgacaaatgacctgttatctaggaggagtaaaacaactatagataagcccccagcccccactccacgtccttgcctcttccactgaatatttcaggggagacaaaaggacaggatctttagagatcgctctgacttgattaacatgctgatctgggaggcaggcttctaggttctcacccaactttttggctgctattcaaaggatttaacagtgctctttgtcaatagcatggtgtacaaagcccatctaaaaatagaacatttccagggtctggcttgggtgagtggattgagtggcaatggctgtattgtacaaggcaaactacagtcaagttattccccggcactttatatgcagggctgttcacaggcttcgtctggtttggttaagtaatgcaaacacatttaccagtgtacatggttgtttgtttgtgctctggagagcttgtgtgtgtttatgatggagagatctgcaagttctgttccatgacaatcaaacaaagctgtccctggtgaggccagcagtggagttaaacgctgtggcccacactcctgagaaccactgacatgacactagggtagttgttaaggacaggttcctgctgcactggctgccctaaaggatttttgctggaggtggaaatcaaaaaagagcctctgactacagtgggtcccaggtctggatggagcctgtgtaaaccacgtgtgggaaagtccgcctgacacaggagtttctcaccctgagatgtatggttttctctcctcttccctcactccttagactggtggagttgctccacccccacactgagatgactgaccttggagaccttggaagcagggatcacggagactctcaagaagacaacagagggaggcactcagaagaacaagaaatgagaacattattttctgaacgctgggaaagggtgtttgaaagcccaagctgtccctcctacagttttcatcaataactgaagggtgtttccgtatcttggggagagaggaatttttgcatgcctttacatttacataaataacctttaattcagtttagagagtcaccgttggtgaaagcctcagtcattctggcaggtggatttccttctaggatatggaagctcagaacagggatagttcttagaggagttgggccgggaaatacaatatagaagatttaaaaaacccagcctgtcattttggcaatctctcccaacccagatttcatggttttaaattgatacatgttgggtgaattgggtctgacagtctaccggctgtacatattaatatccctctcccccttgcttatacggggtgaagtgtcattttcaagagacataagtaacactgagggctagaggaaaggagatcaaggcagttggagcttggtagtagagtcactataatcacaatgggactctgtcagccttccaaggcatagtctctttgcttgatctctctcaaaataggtgtttttatggttaacattgtcattggagagggcataggggacaagcttctgggcacagctgtgagggattgtctatgttaggttcactgaggtgagaagacacaccttaacaatgggtgatatagtttaatggacagaggtcttgtcttccttactgctgccacagtgactaggcggtctcctcttcagccactgatcctcccctcatgatgaagtgtgtgctgaccaactgcaagccagaacaagcctttccttctttaaattgcttcttgtcaggtattttgtcaagcacaagaaagcagttaacacaggtattgtctcacatgctgaatcctgtgcaaacgaccccttctaaatatttccttgattatcattgtatgtaaatgcatggcacaggtatggagctcagaggacaacttccaggggtcaattacttccttccactgaggattctggggattgaattcaggtcaatagtcttgcatagaagaagtactttatctactgagcgatctctccagccctttgccccctctgacgtaccaccactgtcatcgttattgttatcctggctgttgaggaatgaataggaaaaccttaaatcagtctgtcctttctttatcaatgactctcctgtaatgagggttgatttctatttggaactgacttgaaagacagcataaaccattatcttggtcattatgggaatttcctagcctgacttttatttttaagtaaaagaaattatgatttttcttcaataaggcagattttggtttccttcctttaaagagccaggagaacaatggaaatttcatctcttgtctgagatggaacgttcaaaccaatgagagaacaaaaccaaaccaggtatgggcaggatgagttcaaaagaaccttgtgtagttttgctgagtgaatagccaaacagcttcctaaagtgatgggcacagcacaagacacacccaacatgttcataaagttaggaaggtgcatggaataatgctgcatgagggaagtcaaaccactcacaccaaagtggagggtgactcttttcaaaattggcttccagtcctgagttctagatccacacggcagagacttattctcagtggttttcacctagagttaaccaaatccctgcatcagagcattgctctggcaaaacacctaggaaaagcatcttaaggcagaaagggtttgttttggctcacagttggagggtggactcctacattgcagaggaagcatagctgttagagcacaaagcagctcaacgattgcagaaagatgaatgctcgcctggccagatggcccagaaggtaaagatgtttgctgccaaccctcacagcctgagttcagtcctcaagatccccatggtaggaggcaactgacttctgtaagttgtcctctgacctccacaaatgggccatgtgacacacacatgctgacacatgaacatttaacatgcactcatgtgtgcaagcatgctacacacacacacacacacacacacacacacacacacacacacacacacacacacaccaaataaaatttgagaggtgatggtgctcatgttgccttttttctttcctgtttattcagtgtgggatctcagcccactggagagtgctcccacattcagggtgaatcttccctcctagctaagcctcccccaaaacaccctcatggacaccagaggtttgtctgtaggtgactcaaaatcagtcaagttgatcatgaagagtaaccattatggtccctataaacaaaatctcagccaattgtataaatattttggaacagatctatttataaaactttcacatcaataatttaaaaattgtattgagccaggatgtagtagtggtggcacatgcctttaattccagcagttgggaggtagaggcaggcagatctgagtttcaggtcagcctggtctagagagtgagttccaggacagccagggctacacagggaaaccttgtctcaaaagaaaaaaattataggtgactgtcccgtggtgtccacagtgcagcgtgtgccaccttatttagctaagcagatcgtgtacttcattggatgcagaaggagatgaatgggctttgcagtgaatgtgacagttaaaacatctccatcttttggacttgcatatttagttgttaagaacacagttgtttccttcctgaatttcaaaaataagactgctacagtcacatcacactattcagtcaatggtaaaatcttgtttgttactgtcattcccattctttttgtttagaatcacaataaagttgtatttcaaataatctaaaaaaaatattgaaaaggcagggaattttgaaaattgccctaatttgatatttttgctgtccaaataataattgtttgctttttcctcatgtgggaaatatgaatgaaatgaatcatcctttctatcaaatgattaaataagacaaaactgcattttaaaaaattgtaaagaagccacttggcagaaattcaaattcattctgggtcagaacttcttaaaataagaatgcgtgttgaagattgcatcctcctttcaaagttgtattctgttttttggctcagcccttttcaaccggccaactcagaagtgtgaggcctagctgtggccacccagagtgagacacaggagccctttgcaaaaaaaaaggggggggagagatggggaagggagacagccatccagaagctaaagagatcagatgcctgagacaccaaccttgttgacatattttcttaaacaagttttgactctgtggggggggtgtgcaagtgtttatgcgtgttcatggggggaggtacacacacatgtggaggccagaggttgatatcacgtcttcctcgatttttcttcatcttcttttttgagagcttcatatatgagtgccgcctctccaacagtctagctcttcctcctccaacttctcctgtgtgccctccctcccaaattcaccaaactcatgatctcttctttaattgtttttggggtgtgtatgtgtgtattccctccctgagtccatgggtccagtgctgacagcatgggatcggatcacctatatggaagctcatcctggaggagactgattctccttctcttagcagccattggccaccagtagctcttcatttagggctggggctttgaaagacagggtctctcgatgaacctagagctcactcgttagctgactggctggtcaataagctccagggatccacctgtctctatctcccttacacaatggaaacaaacatgcacagccacacctaggctctcacagtcacctggcagacaccttaccaatgaactctcttgagaccccaggctttcttcacatctttctcttagacatgtagcctccagaattacgagacaataaatttcagctgttgaagccacacggcacttggctgtggcagcccttgccgatcaaggtggtgactttgaccaagatgtagggtttgtgtaggtaaagtgagcaagtgtgtgtttcccttctctctcctgtcagtaaacacataattttacttgcatgttattttcctttcctgtgttccaacaggtcatatggtaaggtgtaaagaactgggaagtgatggaaagaagggagataagaaaggaattgaggaagggagaagaaaaagcagaaaaaagaggctgatactgagacatagaaaaagcaacacagaaaaagcagctaccacgggagcagggagtgttttgaaactgagggctgacatcaaggataagaactatggagtatttaacaagatcatccaaaatctttaatttacctgtttccaataaggaagactctattgctcacttgtggcatcttgataagctcaacctttatcttctgaagataaatttgaagattatcatcatagctatgacttactgaatattgatagcccccaggctcatcttactgccacattatttttgcaatagggaaatactagttttttcacagtagatctaagtagtgtaaatgcatctttattaacagtaaagatatggctgaactaattagtcaaacaggacttgccactcaaatgagtctcaatgtgcattattttaataaatatttcctagtgattctgtggttttcaattggctgagaaacacagtagggacagatgccagtatggaaaaataaattttgccgaaaacctaagcttattagattttaccgtgtgtgtgtgtgtgtgtgtgtgtgtgtgtgtgtgtgtgcgtgtgtgttagtttgggttttggttttctgtgttgacaggatctcttgtagctcaggctagcattgaactagctatgtagttaataaggcttaccttgaacagattctcctctacctcccaagtgctgtgggaggtgtgccaccttaactacccaagtgctgcggtagattacaggtgtgtgccaccttaaccagtttatacatcgaggggatcaaatccaaggtttgtgtttgtcaggcgtgcaccctaccaactgagctacatcttcatccctatcatttgttttttaaaaatgatggcatacatcagtctgtggttatacgaccttgtgtatactgttgttgcttaaggacagagcgtttggttctagcttctgagacattccagcctcagtagtgaatttacagaaatacatttctttttttttaattttaaacaaaattctttattgattctttggaaacttcacatcatgcaccccaatcccgctcacctcccagtcccctcatatctgcccctcaaccctgcagtgtgccacccgccaatcaattaaaaataaaacaaaacaaccaaaaataacaactctgcctggctcctccaactttccaacacctcttcattcatcctcgtggcatagggagctgcagtgtgtcacacagtatacccttttgaacaatcaatctcaccccaaaaatattcagttccatgagtcattggtctggttcaaggcctctggtttctggtatatcatcatcactgggctgggccctcattgaaactccgcttggatatcctgttgttgccctgggtcatggagatcctgtggctatcattctgcagtaccagtcccttcaggtactccagcaggtcacagataggcaactgttagggtgggccaacccaagatatgggtctgggtcactgtgaccaccccctcaggtgagcagcagagtcagctcttctaggcccatgccatcagggtcagctctcccatgcctatggtgtggggtggggacatctctcccaagtgctgggctcaactctcctgtgagaggagtgtctgctctcctgctacagcatccagtgagggacagggctagctcaaccttgctcttggatttcaacatgcatgatttctatgaccccccatggaaacaggagccatggacatcagcccagatgacaccatgaccccactggcagcacagccctcagacaccaacatggtcacaggatgccctagaccctgggcatctgtgtggtctttgatagcagcatcggccacagacatcatagaccctgactgtggtagaaccatggacccagacattgtcttatgcagcagcccaggcttggatgtcaccatggctccagcacagcccacccagattagcatggccccagcataagcatagcccttgcgaagcaacatgggctcagatgtttgaccagaacccagtcatatgcacaagcttcagtgatgactgaagccttggacatcaacatgggccctggctgctacagggacatggacccagacatggcccctggcagcaacccaggcccgatgccatcatgtccccctggggtgtcagcacaggccactcagatcaacatggctgcaggggtagcacagcccatgaacatcacaatggcccacacccagagcatccctgtggcctcggttagcaacatgggtcatggacgtcaatgaagtctccagatattgcagacctaaatatagccataggcagcagcccaggcccaggcatcactctggtccagggtagcaagcaggccaccaacatcagccctttccttacagccctcacttcttcagaacagtctctttgcacagcacaggaaccattctgcctctttctctcccgtttcaccaccagatacttgctcatcatattgacacacaactgtctggtgccttgtggtgccatgtgctcatgtggatgtttcaggcaacttggaccgtgaggacccagggctgccccatggggtgtatttagccacctgggctgcatggcatcagggagcctgtggatggagaaatgcatttcttttgttacaatcttataaattgtattggggatgtgatggttaatctctattatcgacttgattaatctagaattcatcacctggaagacaaacctctgagctcctttgtgagggattatcttgattatgttaattgagatagaaagagctgccatagacacctttctctgagctgggaccttgaactgtataaagaggagaaaatgagctgaggatagcatgcaccctctctgccacacagtgaccagataccttaagctttttagctgatgaactgtgacctcaagctaaacatagcccctttctcccttaagttacttttgtcagtacattttatcacagcaacggaaaaggaactgtaacaggcgtgagcaggaaatacaatttctttcctcatactagaaaagtatttggcatgagaactatgtcttccttcagaaggcttcttttcaacctcccagctctcaaaggcctgaaaccaacagaggtggccattgcccaacccagggaaagcctgcaggcttcctgtagggagttcttctcttgtctgggcttgtgatgtgtggtcctaccccagcccacctcagcccaacacactccctctgaccaaccctttggttcaagtttatgcttctcatcagcccctctgatgcttttgcctcccctgtttctgaaatcttttctgaatgtcactgaactttggatcagcttcttgctaaatgtgaactgtcacctgcacagctcaggctcctggaacccagggtgagccttgtgcttttccagagaaaactgtgaccctagaagaactgcagtacctctctagctctgtcaacagtgcaatgctgagatgtagtgatggggtaaacatccaatgcatgtgaaaacaaagagagagcagggagggaaggagggagaagagaagggaggggagagaggggaagaaagaatatactttatgcacagttgctacttcttggtgaaatgttctaaaaccaagaagaaaggcagctaagtagcagctccattttgccagtttgtaagtactctctctgaccactagccccaactagaaattgcctgaaatcccaccacttgggtaaaggccactcttacgcatagaagatttgctcctggtgggaatgcttctcaagaaatggaattttccaaggacaggcagacccagctcagagaacagggcaagaagccaactatcagatcaaagatggtctacaggtccactgtcaagctaattttcctggtggtgtcaggactctagggtcccacactgatcctcgcaatttcctggttgttttgagggcccaaatattctagagcagtctggtctgctttcctgcttgcttcatctccgagggggtgagaaacaaaagcaacaccgactgtgtcccccaggtgatagacacttgcctaggttcctatggaaaacgtactgtggaatgtgtgcttctatagtttgtatataaagtcccttgctcccaccagggttgaccccaacttattccctcccctcctgcctctccccacacttgctagtgtctattctagttttagaaagtgaggtctagaaaagaaggaagtcactgtgactgtgcgtttgaaggtgtttcttatccctgctcccttcctgtctcttttcaaaaggtctgcttactcctgccatggtgtttctgcctcatcacagggccaaaagcaacaaagccagctgttgtgggctgagtcccctgagatcatgagccaaaggaaattctttgtctcttactttgtttgtctcaggtattttgccatagcaacaaaaaagtcacacacacacacacacacacacacacacacacacacacacacacacacacacccctctaccccacagcaatcccttagggcaactgcttgttgaaggggtgagcccctcaggtagtctgctatctaggcctgtgatctttctactgtccccaattccattcatcacagctacagtgaacacaacataagatctggttcttatggaactttggaactagggtcatgagattctagttctctctgggccagaaaaaggagatataaaatcaagaattttatgcaaatcctatgagcattgttctcttagaagtcaatccttaccaaacaagtatcctaagagaagctgaaacaacccccagtgacctctggtttgggattctagactcagaataaggtctacctgagtttctgacataaagagtgatgggggaaggaaagacacaaagattgattcatgggcactaagttacattagataagagcagagtttctggcattgctatagtgactatagatagcaatctatactaaatattgaagaaagctctgggaattgggtttgaatgtttccaccccagaaactagatagttaaacccaattaaatatcagacagagaaaatatactttaaaacaccaaatagtatcctgttcatatgtatagcattatatatatcaattaaaaattaatttaataaaaatgatggatttgagcacagcagcacattcctgtaatcctaatacttgagaggcagaggctgaaggattgctgcaagtgtgaggccagcttgacttggtgagttcaggtcaaacaagacaacagaacaagacctgctttggggaccactgtacttgctgtagctacctaaataagactgaggccaggcaacagtccagctcagatcagaaagagcctcatgagatcccatccacacctgaggaactggtaactgttgactggggctgggggaagggaatacgctttctttaagggtggtcccttttgggtcccatacccatgcagcacaaattggactgagtagattattaaaacaaaaaaaattgaggacatgacattggaggggatgaaccctgaggagttaggagaaagtgtgtggatgaatatgatcgaaatatacagtatgtatgaataaaattctcaaaaagttaattttaaaggtatatttttaaaataaccctgtctcaaaagcaaatcaccataactttatgattctctctctctctctctctctctctctctctctctctctctctctctctttctctctctctctctctctctccccctacaaggttagtttgtgttacctagaatgaaaggaatcctctgtgacacacacactttgacatggttcttacaacatgtctgtgaaacatgtcttatctctactttacagatgaccgagctggtactaattgccaaggccctacccatcatacttttcagggaatggcatttgaccttgaatgttttgatctctaaaccccaggctgttccacatgagccaccgacagtgagatgaatgttccccttggcctcagagacacacagagttgcaaaaatctgatggtgacagaggttctagactccacaagcaacactggccattgggcactcctgataacaggtcccaggttgtgtgtgccatgtctacctttcccttcttcctggggttgtaagtctcccagaggagtgacggctcctagcagggagtgagtgtgcattcctgggcgctgtttttggactatcggaggctactttctgaagcgacaggctggccacaatgcagtgtctcttcttacgcagaattcagaacagggcctccacaggagcacttgcccaaagcgtgtcagtttcttcttttccacaaacagagacagcttgttctcctgaaaacagctgcccagcttggctgactcctctactgctcttccaagcctgctggagaggtggagacgctgcccaggaggacccgtgcctgagtcgggaagggctcccgggctcccatctggcccagaagccaatcctttgatatttaagcacaaaaacctgttacaagtcaggatctggacatggttcccaggtctttctagtggccagcggccattaaaggcttacttgaggcttgcagtacaatgtagagctgtgatcccaaatgcaagtgctggaggctgcattgtctatgctacaagtctctgagacccagcagagctcctcagagacagcaacacactttccaccattcctgagtgacaactcaggtgactgttagatgtctcctgaagccatcatgacatgatcagtaattacagcttggaattccccccactccttcaaagtccatcccacagggcaaggtgagagtaaagggtcttaatggcaggctgagctcacttcagtagtgtccaaatcagagttctaaaataattagtttcaaggctgggaaggtcgctcaacaggtcaaaagatatgcttcacaggtataaggacctgagttcttaactataaaacccagtgaaaaactggatgcatagtagatgtgtctataatcccagagcttctacacagagatgggaggtagagaaaggagaggtcttggaagctctcaggttggcgtatccagcagaaaattaatatagagtccctgtctcaaataaggaggatgaggggggaattgttctttgactttcacatgtatgtcatggacatgacatatgtgtgcctgcatttacgtacaacatatgaaaggatgggtttcaagaatagatgataaaaatatttagtaaaagaatatctgtgctgcagcatgagaagaatgggaggaaagggggaatctcttctccacagaaagcagcagccaatagagtaggcaaggcagccattcttataacacacccaaggcaatgtttgcgtcagatggggaccaggacaggctaatgacattggtgaaagatggttggaaagcaggctattcatgtcttagattttccacagcaaaatattggggtgtaactcatgggatagaatgtcccctgagcatgtgtgaggctctggatttcatcccagcactgtcaacgaataagaatactaattactcaattaaaactcagctatcagatcaacaactacttatcagagaagaatacacctttgtaatagaacaaacatcttaacttggatgctattgaagatatcaccaatgagacacagtgacataatcagttcccttgttatgatgcattatgaaatatacaacaatgtcccatattaacattttacccccccaattaaagcagctataattatgagaaaataatcatacaaagtaaagttgacattctgccaagcaaatgatctggacacttcactaaagaaagaaatgtcatgaaatgaaagcatgtcaggagggttgttctagatgaacaatacgtgtcactaagtgtacttatccaagtcctccctggatcctgggttctgagacaaatgtgacacaagacaaaagactccaactgtttcactgcagtaaaccatttactacctattaccgcattatattattacatcctataatgtggtgttgtaaatctcaaatatatacaatgaaacttatcttttaaagaatataatttcaaaaatgctcactaagtgctggtaaggtatcggagggtaaaagtttgatgacctgagttcactcccaggatccacatggtagaaggagagaacatctgccacacatatgccacagcacagatgtggacacaggcgcacaaaatgaataactgtaaaaaaagtttaaaatactcattagtaactttttataattatcaaatgtttaaatgatcacgttttaaatatactatattaaataaaatattgttaaaattcttaagtgccctggatgtggaggcacatacttttaatcccaacactcaggaggcagaggcaggaggatctctatgaattcaagtccagcctgatctaaatagcaagttccaggacagctggggctacatagtgagagcttgtttcaaacaaacaaacaaataaaccaaaatattttcagtgtatgaaaggccagcatgagtgatacaggactctaatcctagcattaggatgatgtaaggaccagcctgggctgcctaagactctgtttcaaagaagaaaacaaaacaaacaaacaaataacagagaaaatgtatagagtatattttttggtcaattagagacacttaaggatagaacccagattggatgacattaagggacatcgagtgtctcagaggcagtaacgctgaagctgtggatggcactgtctttggaggtgcaactcaaagagcctcttacaaagtgttggaacatctgctatttatttgcagatgattcagaaatgaagttatgcaaatagcatatataaagtgtgtgtgtgcacatgtgaagcagagagttcataggagctaactgaacttaactgaagcgaaatgttaatgacggttgagtttcagtatagcttcctgaagggtgttgcagagagcactaaaagaataagggaaggaaagagttgaattaaacatccaggtaggcctcctaaaacagtgagagaggtttcaaagtaggacagactgaacaggtagtagactcctggaagctgtggaggtaaaggggtttacactatcatgtttcaacttccgagaaacattccaaaacaaacaaacaaacaaacaaacaaacaaacaaaacccattgtgtgctgatagggagatggttcaaaagttgagcacatttactgtgtgggcaagaggacctgagttcaaatccccagaagccatataacagtgccccccccccacatacacacacacaccaggctgcttacctggttcagtgagaaatctctctgggatacagtgtcaagtaacagagaacacctgacacctgtacagacatgtaatacatatatacacacatgtatacatacacatacatgcacacatgcatgtatacatatatagatatagaagtaaaaataatagaccatgttgtgataaaatgaattagggagatgatggctattctttagttttcacaaaatcacagcaactgttgctagcatgctaagtttctaaggggagaagtgcattgaattttgtctaacgtcacaattcctgaacttgtttgatggtgggatccaattttagaaaaattattatattctcatcaataatgtttcctaaaataaatgtagaaaagccctgattcagtctagttcccacacacccttctcgatttttttctttttactattttttttccagttttcttagaaacaggattagacttgcaatcctcttgcttcaacctttcatgtcacaagtgtgtgccaccacactcaaagtcctggagtccttggttttctcaaggtcctggggaaggtctgggctgagagctcagcatagggagcatagggagcagctgactccagctcccatttacagagaaagggaagctatccctgtgaagactggaaataactcacatcatctcaacccaagaaaatccatatttcagcccatttatagactttctacatataggatctgttttgcaaacatgacacctttgtttataaccatggtgacatatgttgtttgttcctaatgtcgtacagtgctcaagagaatgaagcgccttctctgtgtgctgctaacttgggttttaccctgcggttcggacaaaatattccatggaatcgtgatagaatcccgctgtcttaagtgacactgtttactctagctgttgtgataggctgagaaggggaagccatgttttattgctttacaagccaaccctgctaagaacatacatctgctctcaaaccactcagtttctttcctagtgcccgggcagatttgctctgggctcaggcggttattaaaggcagctctgacgctgcagtttgcattcctagcaggagcacagcctgggtgcagggcaggctgggctcagtcaacagatgtctgttgtaaatgcagcctgcttctgctctgccttcctcgcaactggcaatgagaactgaaggagttcccttcactctgtcttttatctcactggttaatagggaagggtgtaaaaggaagccattcttgggcaataaatccagacagcaaataaaacagaaggagctggaagaaaaagtcaatgtaggaggtttccttcatttactatacttaattgggattccatacatgaacaaaggagagaagaggttttctctcaggatgacagagaaggggcaagtggcttcttgggtgtagaggcatttcatttttaagacaggtctctgtagcccaggctggccttgaccttgaacttctgatcctcctgcctctgctattcaaatacatgcctggctggagatcatacccaaggctcatgcatgcctgactcaaccaactgagctatatcccagccctggtatttttagtgtgcaaattagttggagtctgccctgcttaggaaagtttcctgaactcagcacaaggccaatgtctagagacactcagtcagtttcatcggagaggatcatggttgatgggtggctggcctaatcacattctctccagcacagttccccagccatgcacccaaaagttacaccatcactggcctcagacacttccgaagagaacaccttttggttaatgagaagagccagttctcttatctgtctcacacccatcccatcttcagttctctccaacccattctatttcctgcactcaggctagtgagaacaaaacagggctgagtggggaccacagcttctcaagtcactgtctgaagcactggtaggagtctccaaatgccttcctaaggctgggttgcgggtagtgctgcagcaagacaccagtgttttccttcccaacatcccttctccttcagaggacaggacaatgtgtcccgcctcctcaggaactatgtgcatttgcatctttgacatctgggtgactgtgaccatgcttcatctgacccaatgctttaggagccattgattctaccagccggctgggccagtttctctttgatgtagaaactatgtgttcacacacagactgctctctcagtcctcatgaggaatgagaaagacatcagcacagtatagctctcttcattgctgatccaggaaaggcctctgaaattgtacctgggatttttgttatagcatcagatcagactcaaattgcacaagtggcaccgcctttaatcccagcaatagtgagtcagaggcagtcagatctctggagttcaaggccagcctggtctacagagtgagttccgggacagaagaaaagaaaatagattgcaaattgaggatactccagggctggtctccactcattaagctaccagtcagaggtgacagtgaagagtttcagcagcccttgcctctgctgtttgacactaccctcattagtcttcgtccactgaagagagcacagtctcatgtttgagatgacatcctatctgcgagcagaacaagcaaggtcttccccattaaccgcagagaaagcttagcttcctccagagacccatgaaaagcatacctcctttccctctctaggcagctatcaggttaatgtaggccctcttccaaccctgaacagactgggggacctcctcagaggaggagagggacccatggaaaaaaagcatgatgacatagcatattaagtagctttcctcgctgtggcaaaacacctgagaagattgaaaggaagaaggttgactgtgtttgtgtgtcagaggtatcagcccaagactacttggcccttttgcttttgggtttctggtggcacaaaaatcaccatggcagaggcacagggagaggaggcctggttacctcagggtaacaggaaagcaaaaagaaagaaaggaaagggtcagggtctcaatattctcttcaaggatacacttccaaaaatctagctttctctcaccccccccccgaaaaaaactccaatatgacataagcctttattatatgaccatggggggtatttaacgcccaagtcataacataacatgagaacaaatttgactgtttgtactttgcctagtgtctattttcttcccccagagtataaacctactgtaaattataactatatacttacatataaacgtaatgtaaatgcaaacttagactcacattctcaagagagaccaactacctaaaaataaaatattcatgatgagtttgatgatggctttgtgtccttgttatcagggattcccacttgttggttgaagtaggctcccagctttccttaagatagctctgtgaaaacattgactcacacagtctcctttaggagctctctgactataaaatccttatatagttgtgaaatttacattataccaatagatcttgattgtcgtcataaaataaggaattgaaatcaacagatgattataactgacaacagcaaagtaactgtgaactttaaaaatatgctaatgcccatccctgtgcagaaatattagcctatgctctttctgtgacatatgcgtatgtgtttggagtctatttttgtaatagagtaaaaaacagctccaaaaatatcactctcccctttgacatttatcagggacagcaatcgtgtcagggagcatgaacaaacagaagacatgcaagcttgcttcctcaagaagagcttcaggtttcattttaaaacaatatgctaaacatcctgattccctgggcctaattgtaacgatattccagatcaaattcctattactgagtggtgattgtgttcacctgatcttattcatctttgcaaaccccaattcttaagaaacatgactagggagacatctagttcagtaaagtgtttgttatgcaagcccaggaccagggttcaaaccttggaacccatttaaaagtcaggcatagtgatgagtgtttgtaaccccaatactgaggcggtaaagacagatgaagccctgtggctcactgactgaacagtctagtctcctttgtgagttccaggccagtgtgaagactctatctcaaacaacacagtcaaaagcacccaaaggtcgacctatgccctccacatttagccacccccacaaacaagcccacatttgtaggaagggtaaaaattaccaaaattattgtagacatgtatgaatctgtcaaagaataaaaaaataattttatgcacacaaatataaacccatgaggggaggggagaaaagcaggcatgatccgtggtcatacctgaaacctcagcactgaggaggctgagacaggagggttactgcaagctcgaggccagcatgggctacagtgtgagtccttgccactataaagaaagaaggaaggaagaagaaaaggaaataagcataaaatccaggtgagggcatttcaaatgatttgggaaaacagagatcttcatagatgaatgagtgggaggcaggacaggtgggcttggggacacatgagtgtctcctctttccaaacacaaaataagtaaataaaaatatgttactgtttctgtgctgacgcttcctaatctactttagaaagcagacccatcttacctccagtataaataaaaaagtatacatgagcacaaatcaaaccctgataacctaaatcaaaacgtctatctagaggtagcttgcttttagtggtctcttgttgcttccagaggctcagtgaggggtaattttctctgcatgccctaaggtcttccatgaggaatcttccacaggcacatgcacacgctaaggcttcatcatccagggagggcggcagtctggagttgattaccctgctgaaatagtctaggctatggacaaaagttcgaattcaatttctcagcccttcttatatggggagcaggcaaattcaaattagaatgtggctttcctggggagacttgatgggatcagatgttctctctggaggtcgagttcctgtgtctcataggttttatcaaccatttgttggaaaataagaactcctgaagagacagaacttctttcctttgtctctgtgcccttagagctgtcaccctgctgctcttccatttgaccccacttaccactctcactgtctggctcacttgatactatccggggcttctgatactatattccatttgtgctctctacttatttctcaagccattctttctcagagtccaacactagaattcatctaccctctgatttgcaaatgctgaccttcctcacgtttgccctttgtctcagcaagcctatccacgatggctttgctctgaccccctccagtggttttacttctaatgtctgcggtgataactcccaactctgtgcctctcacttcctctcagttccacatctctaggtttacacggctctgtcttaggtgcccacatccaccctgaaaccctgatgtgtgtcctgtattggtagacagctggtctattacctgtgcctagaatgtgaaagccacccaacccgagccaatagacaacctataccaagaaagcaaacaactcagtgtgttcctcaagatgcctgcgctgaggcctatggagataaaaagggcattttccactgtgaagacacctgcattataaggggaaaaagaggaccaagcaacgagacaaagacaaggcaaatgaagccaggggaagtgggacaataaaggaggaaggtgacacacaagagtgaaggcttcaagagacagcatctaaatgaggaacttcttcaattaaaaaaaaaaaaaaaagcaggagaaagggagagccacatagaacagggaaagtatgaggatggtgaaggtaactgcaaaactcattcattcattcacctaactggacgtcagaaattattctaagccaagcaaagataataatgaatgttttagtttattctctctccctctctctcaatccacacccccgcaccggcaccgtgtgtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnagtgtgtgtgtgagtgtgtgtgagtgtgtgtgtgtgtgtgtgtgtgtgtgtgtgtgtgtgtgtgtgtgtgtgtgtttaaatgggaaatataatggcagaagaaactgaaaaagtgagttggagcagccagccctgaaagcagatgtttacttctttcaacttcaatgacatgtactctctacttcctgaggaaagggcagactgctaaatttcagggcctgatattcacttacgtatttacaaactaatgtgagttgacatcgagttaaaaatgtactagcacgtgacttcctgccattttccaaaggaattcacggcaataaagtaggtatttcatgagcccatatgctgtgggtcctttcctgccccctgctttctgtgaccagctctggacaagaagacaaagcaggctgaggaagatgaagtcaaggtggcaggagaagaatagcaagggaggagggggagaagaaggagagtaagaacaataagaagaagacaaacaactcagtcttgcctggtggggtgaacacttcaccccagcccggggtatgtgtagcaggaccttgtctcagaacaagtaaggagacgagcaacaagcttcacactactttcacatacactgaggccattttcgccacaaagggcatatgggcagataaagccagtctcaacaggtgttacatacatatgttccaactcataaaatgcttgagatctgatctgaggtctgagattagagtcgagtgacttcattctcctagccttaaaggagcacagccgcccgttctctaggacaggctgtggctgagagcgcctaggacatgtaatactgtgaatccagcccttcagttcttggattaagaaaaaaagggggggtaggaatttccactaaggaaaagtaccagaactgactcacacacagaatagaggtcgaaaactagctttaatgcaggccttccttgtgtaccatcgaggcagtggttactttttcgaaagagaggtgatttacgatgtctgggactatcagggtaggagaacatgtgtggaacgtgtgtggcgggttggctcatacaagggacaagaaagcctcattagactgttggcactgaagagtatgaagacttctggagtttgtatcccagactggagatcacatctgggtaaaatggcctctggtgagcagcaaaagtcattgttcatttcttgtgttcattatttgtacagcaacgggagcctttgacgttctatgcataggattagagttggtttctctcaacaacttgttaatgtgtttgagctgaaaaagaaattgcacttctaggcatgatgaatgaatacacttgcacctcagaggggccacagaggttatgagtaaggctagagaactccagcaacagcagctttaacgtgttcaaaggctacgaaatctgggagaatctgccagatttgcaaggaaccactctgtgttgtatccaagcagagcattccattttcacaagggctcctttgttgttgtgtttatatgcagactaataaatgcttgaccttttgtttaactgatgaaggaacagtctgtgcctggggagcgtattatttcaagaagcacaaatgaagagaaagtccaaaccctctgggacagatggaaggaatattttgatattggaaccacatggggaaaggcagaagttggcaaacagtaatggaggtctgataagcgaacctggaagcagcatcactgttcttagagcatttcaggggctccagggacacaagcaccaggtatccaacaagctcacagaagcaggggcttagagtgagagatgcctccatcctggtgtgttggaaatgtgtggcctagtaaatgtgctgatttggtaactttggcattctattttaaaattactaatatcttcaaatatttgctttctacctacaaagcggtgtttttctaaaatcagttactggtcatcatatcaacctacaacacagccatatattatttcctatactattttattgtgctggtttttttaacatataagttttttttttttttaagactatggaatccctaagagtcacagtgctagtgagagactttcagttcatttctttggtccaaatcctgagctatgctaggccaccactggacttacatctgcccctctcagtctcaataactgcgagtgactgctttagctggtcagtttgaagtcatgaatatctgaataccctgtgtggttataccctatgtatataccctatatatcccaaactcttgagtatcctagtttcctttctattgctgtgataaaacattctgaccagaaacaacttagggaggaaatggtttagttggcttgtccttccctgtcacagtccatcaactgtgggaagtcagggtgcaaagtgatgcagagatcattgagaaatgctgcttactggtttgctccccatgacttgctcagcctgctttcttacacagcccaggaccaccagcccaggggtgacattgcccatagaggtctggaccctccccatcaatcattaatcaagaaaattacctcccccagacttccaacgggccaatgttgagggaggcatgttctcaattgagatgccctcttctcagatgaacctggcttgagtgaaatgggtcaaaaaaagtaactaaccagcccagaatgataaccctctggtcaccattagagtgacagtgctgtattcctcagactttttgtagtgattcatgcaacaccatttctaacatactattggaccattcacattacatataataatagtcggtgatagtgatgacaatgcttagttaaaattctgaaaataatctgacttctaccttagaaagactttattttggagtttagtggccagtgataaagaatggattccaaatgtggaattgaaactacatgtacctaaaatgtaatgggaaagcaaggaaaatggaagtccctgactcatgacagataattggtctcccttgtgggtataatgaactctgccctctgctccatgaaacagagtgtatggcccttctgaggatccatactataatgagtctttctctgtcctgccagccagctcccaaataacgacacagagacttcttattaattatgaaagctcagcctatagcttaggcttgttcctaactagatcttataacttaaattaacctgtttatattaatccacgttctatcatgtggcgttacatctcctggaatctttctagtacctagattcctcctcctcttcctttctttccccagaaatcccgcctaaccctcctgactagttattggtcgtttagctttgtataaaatcaatcacagcaatacacctttccacagtgtacaaatatcccacaatacctcaatgagatgcattcagtgggaccaaggagagttctgtagcatattctgtagcagggtgagggatgggagtgagaggtttgacccctgtgtgccttctctccctggggagtccaggtggacagcattgtaatctgcttgctagcatttctttctccctggcattgttttcaaagtccacagataagctggccttctgaaaagtctacgtgaactcctacaggcagagtcattgtaaaggacagtctcctctcagaacaagaaggaagcaatgccccacatttaactcactgtgttcaggcatgtgaaatataaatctttatttctacaaaggagctaatcttgcttctccagcttttcctatgccaggtgatgtgggaggaaattgcagaattgctgttgaaagccatctcagccacctcagtccaagatagcaccactctaaattagtatagcatgtctgtcatgttagttttctgtggctattttataaaatttaagtgaatttggtgccataaagcaacatgcatcaattctgaagttccctagttcataaatccaaagtgggtctctcagagctaaaatccaggtgccagtgaggccgtgactctcactctcggctctgggtgactctgtgtctctctccactctgggtgactgtgtctctcagctctgtgtgactctgtgtcactctacactctaggtaactctgtgtctttctcagctctgggtgactctgtgtctcactcttggctctgggtgactctgtgtctctctccactctgggtgactctgtgtctttctcagctctgggtgactctgtgtctccactctggtgactctgtctctccactctgggtgtctctgtctctcttcactctggatgactctgtgtctctcactctgggatctgagtgactctgtctcttggctctggtgacccttggtccttttctctctggcctttgaggctgggccaccttcctccccttcagagctagccccagtggtcctcacggccctttcctctgactctgctctcctacatttaaggactcttttgatgacactgggcctgccaagataatcccagacaaatgcctgttttgaagtctgttaattagtaactttaattccacctgaagtcttctttcacagtttgcagagaataagatgttgtcttgttttcttttcctgttgggatgagaaaatatcctgacaaaagagagttaagggaaaggtggtttatactggctcatagttcaagggcacacacacatacaaagtggtgtgggtgtatattctatggtgttcctacaaagacaaaatcacttaatatatttcttggtgtgggcctctgtggttaagtgacacacggttgtagtcactttacgagatgtaaattgactgcctctgaaatgtaatggcttaaatcaacgatgtcttaactatcaaaatggcaaattggttccagtgggtcatctgctggctgactagggagcaatgtcagtttctgtctcttgtggtagagctgaagtcactcacatggccggattcagatcggcgcttagaaatctagcctgtaaatccacagagtccttttctttatcctcatgtcctttcgtcattcagtggtgtcccttgaatgtcgttacagcatggcaaccagagaacaagaataaaggttgcaggctgtgtcctcaaactggcacagctctgttcctgttgaaatcaaaacagatgcaggttcagccagactcatgaggaggagaatggattccttgtctctgtacagagagaggtgtgggagatgctagcgtgagatcagccagacttcccgtaatgcactctcagaataatcagactgtgacactgctccaagtgtccaaagcattggttgtgggcatggttgttctcagtctggttggagagatccccatacagccctttgccacaaagtcacctgacttccatcaagacaactcctgctagtctctgaaggcagcctcagtagctacattctgcagccctagagttgatgagaactgggacagcctggggtacagtatgagactctttctcaaaaacaaagaagaaaattatgtatgtatatatgtagattttgtgcactggaccactaagcaaagctaaagaacacgaattttgtctttcccaacttactgtattgtaagccatttttaatctgccaagcatttgtggtccaggcagagccaccttgcagggcagttggaatgagagctacagcttgcctgctaatgagtcttacaataaactattgtctatttagaacagtgtagtatgaattctctcctttctccacaattttactacataagatcaatgagagcaaacatgactgacagcttggacagaaggacttctcccttacttctttctatcagatagcagcttttttcacattgtaactcatgtataaaaagaatttgtctagactagggttgtagctcaatggcagagaaagtgcttagcatgtgtgaggccctgggttcaatccccagcaacaccccccccctttattctctctccctctctctcaatccacacccccgcaccggcaccgtgtgtgtgtgtgtatgtgtgtgtgtgtgtgtgtgggccctgggttcaatccccagcaacaccccccccccagaagtagcatatgcctagtctatcacttacagtactgggaaagttaatcggcaaatatgaagattacaaacaaaaatggttagtattttcaaaaagtactgtctccagagaaaaatgaacctcaggctggggatgtggctcagttgtatcctgtttgcctactgtgcacaaggccctgaattccagccccaccaccatgtacatacctgcaatccagtactcccaacacgggcaagtggaggcaggaggatcagaaattcaagttcaacttcagctacatagcaagtccagagctaccctgcagcaacatgagaccatgtctccaaaaattagatattaaaaaggaaaaataagtaaatgaacttctaattaagatttaaatatcagttatccaggccagtagatacaggaggaggacagaggaggtcactctggtatcttctatattatagatgcaggagctgtttctcttgggacaatggctcttgccaaagcagagcacccatgaaggaagactcagcaagagccaagagggagctcatgcaccctaccttgccttccttcctgcaacccctgccctcacaacacacacactcagaaggtgccggtacctgtacctcccagagatcatccacctgacctgctcgagaggtctggccttctttatagacagcagaggcctcacttgctgcacacactgcctaactctcggtattttgggtgttttgtcttgttttgactgccctaacagaatacttgagactggtaacatagaaagaaaaaaggctatttgttcactctgggggctgggaattccaaagccaagggccagcgtccacaagggctttcttactggaaatcctaagggagacaattaaagagaaaaaagttgaggactgacaggtgctcatttgtgacaatgagcctacttctgtgacaatgacattaatttagccctgagggcagaacttcatgactaaagcacctcttcaaggtctcacatctcaacatcatggcactggtgattcagttgctaaacatgaactttgggagatgcgttcaacagcactgtgtagtaacctagctggagagacctacagatgaaacagaaataagcaaagctttcccactgccttcatccctctgtctttgagttgggaaattcctgactgtagacatataccctatggctgagtaatttaaatatgtctacaaccagtgtcctatatatgcaggtttttttcatgagaaacatgcacatttgaaagtaaatcagacaaaatttatactaatgtagaatgtcatctgccacaacacttagaccattcttggagattctaaacttagaaatcatgtgttgaaagaagaatccaggcacagtgtctcatgtctatgaccttagcattcaagaggctgaagcaggagaatgtcacaaattcaaggccagccaagatagcttagggagaccttgtctcaaaataaaatgtagagaaagagccagagcttaatgcagtgattgagtcctttccttgtatatggggtaggggctataaacaaaataaaaaatcaaactttaagcctaggaaaggcatggatactctaaaggctccagaatgtcagatagggtctggaccccccacacagaatcactgcaacctcacaactaaacggtgttgatttagacggttggcattgtatcttattctcctggaacctacagactggggcggggcgggatacttggacataggggtttatgtagtcttcataccctggtggaataaaaggatgagcatctagtaacaactgggttcagatcaaacaaacaatggaaacctaggtgaggccagagcccaaggagatggtccaaagaattcttctagcaacagagatccattttaaattacattaattgagatgctacaatgtggtgccctagtgagaaccctggaccagaggtcaggatacatgcgtctactctgagctttggttctgccattgacacttatgtgaccttgggtgacagtctctccagacccccttgccttgattttctgaagttttccttggatagtgagttggtgatgaggcatagaagagatgaggtattcacataagcaggctgctttgagagatagtttaatgtccattagggggaaaatactggctttctttcttgacattgagtagggactggaagtgtggctgaaatcaagccctgggtcattggctcaggtatgtaccatgggacccatggaagaagcatgctggatctgcagagactagaccctgcatctgagtgggactgggcaagctgcttctcactgcacacacaggccatgtagaatactgtgtgggtggtggaactgaggacacatctcataggcaaaggctagaggacctgaaatgtttgtttcctgtgttcctgatgtcactaactggaatactcttttcttatctcaaagtgtctattctgtataatagttacctttctcactgtgtgtcaaaaatgttgaggagaagcaactcaaggcaggaaggattcattttggcttacagattcaggagtgtggtccatcaaggcatggcagcaggaacacaaggcagttggtcacactgtacttgatgagcactgatgctcagctcactttcttctttagattcagtcacaaattcaatccacatgtcgtcaccatccatacttagggtgggtcttcaattaccccagtctagacactctttttcagacatgctcagtgattcatcttctaggaggtagtagagcagtggttctcaaccttcctattgctgcaaccctttaacacagttcctcatgttgtgttgactcctaccataaaattatttcattgctgcttcataactgtagctttgctactgttatgaaccataatgtaaatatctgatatgtgaccccccaaaggggttgaaacccacaggttgagaaccactgttctagatcctgtcaaggtgaccataaaaacattagatgctgtttgagctgctaacttatgaacaacagtaatttatcacaggtattgagtctggaaagtctaggatgaagggtctggcaaggccattacctgatgatgctttctgcagatgtccttataggatggaaaggatgaaatgagcttgacaagcctactttgacaaaagtcctgatggtacccaatgaaggaacccttagaactaaccactgcccccgccccaaatccttcctactgttgtcatctcaaggacttggattttgcatgaattttagtggagcataaacattcaaacctaatacttgagaaaaaatagtagagagaagtgtaaaaaggcttcaagtaatttttacaattcattcaaggtatgggggaggggctctgggaattggagagatggctcagcagctaagtgcactcacgactcctacagagaacctgagtttagttcccagcacccatgtcgtgaacatcaccactgcctacaactctgataccaggagatacaaagccctctcctggactctaaggtacctgtgctcacatgcatgcataaacacacacaataaaataaataatcaagtaaacaaaataatgaaatttaaaaagaaaagtggaaacttccattctggaaacccagacttcaggagctgagggtgagaagcagtttctttcgtttctgaatttgtggatgcctaaaggtggggggcgtggatatgaacatgacaagtagggagctccctttgggaggtttgggagagatcatgagtgcctgaagagcagctctgatgttccctgactcagcccttccctcgcccatatacttggtgagaggctagaagtccataaaaaagattgcggggtttcaatatacatggccctcattcaaagcaagcaatatctaaaacacaatatcctgaatctgacatagattaattacagaggaaggagaaaacgaagagggtcaatatttattgagtatcgtctgtttgccaagaactatactgggtactttacgcacatgaattaacctttgcaatgagttaacctttatggtgacattaaccccaaagtagccctcagaatcagttacttatagagataaatgtgctgaggcttagagatattaaaccagttgtcaattctcagttaccacaagacagaaccaggcctacctaggactcaggtctttcaccaatgcctcccaattcacctctctctctctctctctctctctctctctctctctctctctctctctctctgtctctctctctctctctctctctctgtctccctccctttttccctccctctctccctcgtgtgtgtgtgtgtgtgtgtgtgtgtgtgtgtgtgtgtgtgtgtgtgtgatatgtatgtactggcactgaacatagggtctttcatatgttggaaaactgttctaccactgaactataccaccagctccaatactttcttccacaggtctgtctgttctattattattggattagacagcagtgtgatagaggcctgtagccttgggaaagtgggttaaaaatcagaccctttaggcagcataatagacaaggcagaacaaaagatgagcgaagactctctgtgccctacacagaatctacactgacccttaataaagcagaaacatcagctatggtggtgataacttcactgtgttcattgtaagtgtgataaggatggggaggacacaccagaagcccagatggagatttcccacagatgggctctgtgaaaactgatctgaagccaggaatggctggactgagaggacaaaaagccagcccaggactggctgagtagaatgacagtatctgcccagagaaaagagagccaagtacagcagaggccacaggatgctgagatgtgctttgtaagatagccaaggggctgggcagatgactcagtcagcaaagtgcttgccttgtaagcatgaagacccaagttcaaaacccagaagccacctggaaaggctgaatgtggcagtgcacatttgcaagtcctgtactggggacacagagataggtagactcttgagaaccactggcaagccagcctagctgcttgtcgagtgagtggcacttgaggaatgacaaccagtgtcacacaagcacagcacttggacagatggacacacacacacacacacacacacacacacacacacatgttcttagagcatttcaggggctccagggacactaccaccataaacaagtcctaactttgccccattcactctggaattgattagcctgttgtactgttggattcattgcaatgccaaatgaatatgtctaaattaattacttaccaatctgcattgtcagaaaaaaagtgagttttctagggaactgaggcttagaatttttaagcatgaaacttctgcaaagtttcatccttttcatggaaactaataaagtgaatccctgtctactcagcctcattaaacacaatacactgaacatcatttaaccagcgcttgatgactctgagtccttgctgggaaggaacatcagcctctactgggcagcagcataatatgccctcaggggctggtgaaacaggcagggcttctttgtacccctgcagccatcttttccacactcagaggtgggaagtaccccgatgtccagcatctatgtggtgacttctctcaaccacaggcctctcaccattgctttctgcttggaccacagttctcctaacagattatcataacccttacataaagtgacagctgccatggaaatcgaatcagctaacttttaaaactgcctccatctggatctgtagttctctatcaccaatttaaaatataaaggttgaaaagtaaccctgggcttatgccataaataaatcacataaactctggcagggaatttccttgggaggcagacgtcttttgtatcatcactcaccagcattacagccagatgctgtgtgcttgtgattttcagtctgatgtgggatggacaggacattgttaacatcaatccgaaggtttgcccttcgttttctaagatgatgtcacacagcactctggtctcatcctattatctcagaattacttgtcgacagagaagacaccgaaaggtggactctcctatttgaatatcttgtcctttagacaaactccagagtgcagtggcttttggtcagcaacattagcatttctcactgcccagnnnnnnnnnnnnnnnnnngccaggcaggttcagccaggactcacctccctcatatatgtggagggtctcagctgaaagagcttgtcctcttctcacatcttgtcccaggctccagcagacaagcaagtttgttgcaaagatggccaagagaaagccagtcactttgtgaaataacattaaagcttctacttgggctggcaaaatggcttaatggataaaatcactggctgccaagcctgctgccctgagttcaatccccaggattcacatagtggaaagtaattagctgtatcaccagcatgaagggcatctcagtcactggcaggaattaaaagagttgccctgaggttgtcaacgcacagtcttcccttacatgttaccacttttgtctcttgtccatgcactgcttggactattctcttgtcagagttctattcttccttccacaataaaatgtaggactctcatctcctttgacttttctttcttgaattatctccataaacacatctcttccaaagctcaagtcttcattagggtttccattgttgtgataaatgccatgaccaaagcaactgtcgccaatcatccaggacagggcaggaactcaaggcaggaacagaagcagagaccatggaggaatgctgcttactggctttctatctctgacttgctctgcctgctttttttatagcatctgggaacaccaacccaggggtagcaccacccacagtgagctgggtcctctctcgtcaatcatcaatcaagaaaatataccacaggcttacccataggccagtttggttaggacattttcttaattgcaggtgttcttccaaaatgaccctagtatgtgtcagagttgacataaaacctagccagaacagctcacgataaacttcttggcaaatgatttcacagacacatccccagtttcgagacttcttcacagagtttggctacagctttcaactggcccaaatgaagatacccaactatctaacctagagttatgatgaaaactactttgacttcgtactgagaagacagtggcaggattgtatgattgtatgtgtccttgaagcttctgtgtcatttgagtctacattttccttcatatgaaagaggttagggtggtggagggaggtagtttaggcctaacatttgctaaatgcatgtttaatatggtctcttagctgatgagggtgaacatcttctagaattgctttcaaagaacacataaggagacaattgactgcgcacatgaaatctgtaaggctagcatgtcagagagcatagtaacatccaagaagatgagatatgtgcaagctattaacctagtgaatggtgcaataatgcccaagaaggtatgtatgtgcctataaacctagtgaagggtacagtgactcccaggaagacgaggtatgcacattcctgtttgttgtaataaggatgtgtctggttgtctcaaatgattcttgaatatatattaggtttacaaagcaggaacaccctttctctgagagtctgaaatggtgtggagggatggctcagtatttaagagtacttgttactcttgcaagagaacttagagccaatttccagccctcaaaactgcctataattccagttcaggacaatcccttgttctctggccaccatgggaacacacatatacacataaataaaaataaatcttaaaagaaaagattctgaaaaatgggtcacaaaataaaattatgactcttctttttctcaccctggtgagtggacaattctcattttgtgagtacatttcattcagtaaaaatgatgggtgatcatgactaaacttgccaaactctatgttcccggccaatttaatagcacagctttaactcttatgggcatggaaactaataaagtgaatccctgtctactcagcctcattaaacacaatacactgggccaaaacccggacataactcaagaggatgctgatgacttggttctcctttttatcagtatggggattttaacacagggccttgtgcatgctaggcaagtgttctaccactgggatcggcccctgctttcatggaatggttctaacactatgttttccaagatgattttcacaagcgtatctgagtctttccttagacatataaaataaagctctgttgtatttttcacatcaataacatacacagaaggtcctagatcccagaatggaagatgatgtgattgaacgtaagctggtgaaaatgaaagaaacccgttctctaggaagcaacccattagcttgccatatggccagagtggtattagtttatctttttatttttagttgggttggatacgaatccatgactgatactgattcctctttgctccttttcggtctgttcatattgttgtaaatactcatgtgaagcagccgggcctcttcttgctgatggctttctctgggggctcattctagaagactgccgtttaagaactccgtgtcgaatgtgagttatcctgcgctgttcatggctcttaccactgtggccttcttattgtcagtatctgtaagtaccactgttagtgaatttggctagcagcgtttgaagcagatgagattttagctcacgccttgataactgcattggctcagtctaagcgaaagccttattttcattaaagggagcagacatgctgaggaagaaggtgctatttttacatagggtctttttttctactgaaaccacatgataacactgtgctgttaaaatgatctccagcatgctgagttagctgaagaaacaatatgcatgttgccaaaatcaaggcggtactattctgagcctcctccacttcaacctctagctctccttggtggtcatgaagaggagaccagggcggagctagtaagaaagaatgtcacagacagagtggaggccacctacaaccaccagcaccagattatatacattcttgactatttggttattgactgccctccgtcattgacatatgagtagtttctaattagatatttgcatattactggtatttgttcagtactctttttatcacacatacacatatacatgcacacacacagagtcagtctctctctcaaacacacacacacacacacacacacacacacacacacacacacacgcatacacactgtgcagaccaggctttcctctaaattatagagatctgcctgcctctgcctcctgagtgctgggattaaaggtgggtgccaccgtgccttggtctatatttagtttttaagtaaagccactataaagcagaattcaggctaattttggaactttgcaaatagagtaagtttaagttggtacactccaactttactttttctttaaagatattattatcgtaatttatattattgttaatacgattgtaaatgccacgattgaatatacatggcaggtgcttcactaggccatctataaaatgtctttgttgctccccacagtgattggtgtcttatctccctttgcagaagacagaagttaggctcagctaggaagtgagtgagtggaggttcgagcctccatgtggctatctagcttcaaagcctccatttcttaccaggctttctgcaattctgtgttgataatgaatctggccctccactatgcggggctcagtcttcattctccctgattttccatcccctatcttcaaaaagtactaatgagagcaagttaacacaaaccaacaacagcacaatgacggtggtctttgtgttcttcaagccctgcatttaaactgcacaccagaattggagtgaagtacttgttcacagacaggcttgtacttgacagagaaaataattggagtatgtgtcgagcagacagatgctcacatagaggactgcttattgcttctctgccctgtctctgaagcaaacttgcctttgtgccctccatattccccaggatctgatacagattaggggcttggagtaaggaaaacaccatagctgccaggctcaagtagccaaagactgtaactacacaaaagccactcagaaagatgacaaagcagataaaatgagatcaacaatgcaatgccctgggttttagaaagtaattaagagaatttgtaagaatagaaaacaaactatttggggaggggttgccacatatgataaaaagagctatgaaaagaaattttaagacatttactaagtattattaatacaatctcagctccagtcatttttctaaaaaaattaaggaagatgttaactaattaatattcaatgacttttgtagactacactaatatttccttggtaagacagtcacaaggccaacaaactccatgcaggttatactctgaggatggctggcatatgaaaatatgcacaaaacattgatagaaacaagagagaacctgcctcgagcaagatggaggtgagccctgacttccaaaaagttgtcctctgacctccacattcatgccatagcacaaacaccgcccccccacacacagaggaaaatgctttaaaaataagtactgtttcaataaataattaaaattacattccttttatctgtttcttaggttctgtctaattagttctgagccagtcagccatcggatttcagaaacttatcaacttccagaccaaaaggaaaaaaaaaaaccaaaaaactaagacctggaatctataactgagtctctcagtacagcctagaggttgtctaaggctgttggtttagaagctcatattcagagcttcaagtatcaatgatcaagagtatccagcatgcaggttgtggtggcacatacctcttaccccagcacttgggaagcagaggaaggtggatctttgggttcaaagcaagcctggtctatagggtgagtttcaggacatccagggctatgtagtgagaacctctgtcaaacaaaaacaaaaagggtttgtatttttaacatattaaataactcaacaaatctactcactcctaatagtcccttcatcataaggtcaaggagcaaatctttgtgatgtgccagagatgctaaggacatcttcaaagtatgcttggatataatgaatccagagacctttttctcctaatatagagtctggtcttagaaagggagaaggaagagacagaattggagttgaagtcagatcacaagtgcctgaggaaaaaaggccatcatttatttgttaaagcaacaatactaaatttccgtaagtgcaaaagtaaggaaaattattttattttattttgtgtgtgtgtgtgtgtgtgtgtgtgtgtgtgtgtgtgtgtgtgtgtgcgcgtgcacgcacacgcgctcacaaatgtatgtgaagattccctcagaggccaggaatggggcatcagattccctggagctggagttacaggtggttatcagccaactgatgtggtgctgggagcagaacttggtcctccacaagagcaggaagtactcataaccactgagccctctctgcagcctcgtataacaacttcaaagactcttagacatccaggaggcgaagcgatttgttcaagcatagacataatgaaaccaacagaaaattcttctggtgcaatgctagctagtctctactctctaggtggctgcgtcacaggtgaatgacagctgtgtgttatcccttgctcagctggggtgagggggtcacgttttaccagagataaagtcaaataattctgttttgatattaattcagtatttggcaataaagggtccaaattattgttttttaaatctttgaataagatcatcaaaactatgaaaatgtcaacatattttattgtttcattttgaaaagcaagacaagaatggtttattttttgcaaaccgtctacagttttctatgcccacttatgttttgtctttcttgtcagtttcattttctggaacagcattttcttttacaacannnnnnnnnnnnnnnnntctttccttggaaaacaacaacttcggaggctggggaaatggctcagtagttaagggcacatgctactctcacagaggatccaagtttggttcccagcacccacatggcagctcacaaccacctgtaactccagtttgaggggatctgacaccctcttctgatgtctgtggatactgcacacacatgttgtatactcacctgcagacaggcacacatacatgtaacttttttaaagaaaacacgatttttttctttattttggccacattgcatttctcttcatcctgtgtgcaccactgtcattgttaccctttacttgtcttaattattttataagtataattgtatctgtttttgtctgggtacttgatgatagagatcagggtccttcactatgctaagaaagtgggatcactgctcttgcattccctgtgcagttaagcataactttaagcaaatttactgtcttagttaaaattctattgctgtgaagagacaccatgaccacagcaactctaataaatgaaaacatttaattggggctggcttactgttcagaggtttagtcaattatcatggtgggaagcatggccactcataggcagacatggtgctggagagctagctgaaatttctacatctggatctgcaggcagcagtaaagaagagtggtctggcttgagcttatgaaacctaaaagcctgtccccagtagcacacttcttcctacaaggccacacctactgcatgaaggccacacctcctgatagtgccacttcctattggccaagcattcaaatacattttcattcaattaccaaatttaccaacctctatttcacagagaaacctagatgaatggttaataaccaaacattatatattagcaaaagtgagcatgtttgttagtgtgtctaaagcatgtcactgtagcacagtgtgacaaaaaacaatgtgcttacatgtttacaattatgtttagtattttgtattccataaaaaaattatctaggattgcaaagagttcccattacttgagtgaatattagtccaagattttaaaattaagctgaggatattagaagttatggttatattaatatcctatagagtataattatcaatactaatagattgtcagaactatttttttattttacacaaaatgattttttgcctgcatatatgcctgtgaaccacatgtatacctggtgctcacagaggccagaaaagagctagagttctagatagctgccatgtgggttctaggaattaaaccagagctctctggaagagcaatcagtgttcttaagcactgagccatctctccggcacagattgtcaaaattctgatttagtttggctagtaacgcaacttcattgttgttgttgtattgctgggaaaccagggtcttgtgtataccacacaaacattacactgagttctccagctctagacacaatttcacctgtgtttcactctccttaacattaagtagcaatgttagcttatgtcattaataaaccagcatgcaaaatgagaacatttagaaagttaacaaatttattctgaaaagtaaaatgtacaagtgcattttatttaacacactaaaattcaaccttctgtcttaaacccaaactataaactagaatgatttatccaaagatttcctatgaatatatccaacagatttagattatcatacaaaagtccttgtgttagcactttctgaaataatttttactaaaagactacatttattatatttaaagtttagcttatttaacagtaattctagagatatagatttatataaacatctattactctccttaggtcaactaggacaaaatctctttgactttaaagatctcattgtgatttattaaacctctccgtggttaaaacaacgtgacactcacagggagaggtacaagcatttctcagttgcagagggctggctggcttcaacatagtgacctcagctctgggtcagcagtaagcatggagaccaagaactggatcttccagttctcaaagcgctgttttcctttctagtgggtataaaatattttcctaattaatttgagctcaccaatggacaaataaacaaataaaaagatggacaaactggataagctctcatctctctgcaggtagaggacagaaacagaccccattgtccgccttccagagagcaccacattatcaaaccacaaaaccaaggtccccatgacaatcagctactgtgcatagcagaatatgaacacaaggcatctcttagccagggaatcaaatccagacctgcacagcactcctatacttaaagaggctcacatgtgtgaccacaggttttacaaggattatttttagattggtacagctgatttgaacaaacataattaacaaacaaaaaccaaaaaaccaaaacatggactcactagggcctggacccaggtgcagaaagagactctgggtgcaaacatgatgatacaccctaatctgtgcacttgccacttcttgcagtgtaaatcctcccacgatggtgacttttgagctgtcaacacactgtcatgagttcagtgttaatcacaccaggatcagacacagtccttccaaagatctcagcagacctcccagagtggctccagccctcagaaccctcacagacaattcatccaatctgtaagtctcagactcaaatgcgtctccttacagtgagtctattttcctaccgcttctaactggaggatttatttaactctgggtaggtgcacaaaataacattaactcttcactgcaccgataaatgttcaaagtgcagttatccttggcctagagagctagtgtcacacacttcaagataaagaaactgagtctcaaagaatctgatgacttccctgcttctataatgtcacactttgtcacatttgatgaaattaagggtaaaacttaaactttttcacaacacattccttctgagtctttgttctttaactgtgttactacttcatctaacattttaaaaatgattgtgtgtgtggcacatgctaggggtgtggtgtatgtgtgtgtgtgtgtgtgtgtgtgtgtgtgtgtgtgtgtgtgtgtgtatgtgcgagtatgtgtcatatacacatgtgtgtacaggtacacacaaggaaaatgccaggtgtcctgctctgtcactctctatattattccctagaaagaaggtctccctgctgaatctgtagctggactggcagccaccaagtcccagtccttggctttatcctttctctactctccacaacagaagggctcatagttttcatatgggtgttggggatttgaactctggtcctcatgcttgcaaagcaagcactctcagtaactgagccatctccccagccccagaatgtttttaagccatctcaacttttaggtctctgtttagatggcatcgttctaaaagccagacacctaggagctgggcagactgcaggcacttgggtgtatgagttattgttccaaacaatcaacttactaatttttaacacctgcttcccttttcaaaagctaaaaaagcctaatttcagagaaaagcagaaaagggcctacatttgttaaagttgggcaaggggctgggcgaggggcacagctcaccagcagggcacttgcctggatatgaagaatggagctcatttcccagcaccacacacaaggaagttaaacccacgaatgagtaggataataaagttggttttaaaacatttgagaaactagggcttatatagactgccaaaaaatagcatttttaaaaaaaagaaaaacaactggatgatagccagtagggcattaaaactacctttatttgaggctatctttccactgaaaagaaacctgaaaattagcacgtatcttccagttcctgggctccaagcagcaactaatcccaaagtcaaacaggacacaccttcctataaactaaatgctccctaggaaactgtacacaatgccccagtgcaaccttgaaaggcacacagctaatttgcttgctttatcttcaaatatcttcaaatatcaccacagtccttggtgtctttttaattatgaaccattgtttccctgccttccagaacctgctaaagcaaagcaagacaaactgtctgtctttttttttttttttttttttttttttttttttttttttttggtttttcaagacagagtttctctgtactgctttggaggttttcctggaacttgctctgtagaccaagctggccttgaattcacagagatccgcctgcctctgcctcctgagtactgggattaaaggcgtgaaccaccaacgcccagccccgactttcatttatttctatgaccttctttctctccctcttcctctccttccctcctgctcttctccctacacctccagccccatctcccctgtattccaagctgggcccctggcctcaaacttactatgtaccttgaacttctgcttcttagcctccacctccagaggatggacttccactctctgcagtgctgaggatccagcctggggctttgtgcctggtctacaagtcctctacccttgagccacattcccaggccctctctagagcaaacttatttctacaagtccaatttatttttctttccagcacaagatggatttctctatacccataatcagtaacggtcgattgagaaaccttctgtgtcacaaggtagccagcaagttaattggtagaaataggttccctctgtaactattgcccactggagatctgggctaagagacagataaaccagacagctggctgagcaataaaggaaaaagggataccaaaatatcaccaaacccagatgtaacatgggccaggtaatacatttctgcccaccatacctaacataaccaaggattatatgaacaggttttgccaagtggaaacagaaaatgcttttaaggaggaaaaaaaaaaaaaaagaaagaaaaaaagctcccatctgcaccacggcttctctgttgaattttctccaggaggcaaacaaaagcctaaacagacctctatggctaagagctacacactaaaccttaattctggcccctggagcaagacatgcctccaagatatgcttcatctgaaattccaaagcccagtgagcagttctgaactatttaccaggaatggtagttaatttagttatttaaaccataaacccttcaccaggtcatcatttccccatcagaaaccataaaataactcaaaaagattataatacaataagtttgggataaagatggaaattcgtgcctgatgaaaagctgggtgaaagaccttgtcaggaaagtcttgctgataacccatgaagtcacctctgttcttactctcaaatgacctgagttgtccactaatgagtgccataaagacaggaaacattttcaaaaaattaaaactttattgttatgttaccacatgtaatgaatcccttatttttatcataaaaaaatcacagacattttactagtagaagaaacaattccccacctcttgtcagatacatgtttaagacacactaaagggatatgggtttgtattgttgccaaattctgagccacaactcctctggctctgatgcttggttctaacatctggaaccatgcaaaatgagtggaccagtttccatatggctgatcttcagatcctgctgcaggcgtctcgtctctgaactgagcacaccctcactgaaaatggcttcaagatttgtcatttgcatgattaccttcctgcaggggggtagtccagcttactagtgtgtttgagtgtgactcccagcaccaaacacaacctgagaaatgtctggggctggagagttgcttcagctgatgtgcaagcatgagcacaagagatcaaatccccagaccccatgtaaagagctgagcttggctgcactcatgcttgtaaccctggtgctaagaagattggagacagaggatttctggggctcattggcagccagcctagctctagattcactgagagacccttcttcaagggaaacagcaaaaggatagaatagaacacctgatgttctcctctggcctttgggtgagtttggggactcataagcacctatgcataatgcatatactgcacacatacaccacagatatattcacatacattaaagaaggagaaagagatggaggaggagaagggggatggaggaggggatgaaaaaaagaagaaaaggaggaggaaggaagaaaaggaagagagaatgggaggaggaagagtaatagggaggcaggggaagaaatatctgacataacatttacactaggcagtcattttggtcaacctgttttgccaaatccacaataaaacaagagtcaaggaaacgtaacaccaaatacctttgaaggatggattcagtgccataagcttcctggagatgatgagaattctttccaggctggggcagccagacaagttcagcccagaggcagaaagtgccacactattcagagagcagacctaacaaaaaggctttgtgtggtgcatgaggtgattaggagggagcagaggacaccaaagccacacagataataactgaaggaagtttctaccatcttggttaccctgcaaccacctgggcaggacctgaagaaggcataggactttcccagattccattgagggaaaatgcttaggtgtggagcgacagccaccaagaactgttgcagagatacagagcccagtgaagaagaggaggactttaacatctaaggagcttccagtcatgagaatgtcactgcgctaaggttgcctctcaagagagttccacatctctcctgaggctgcctcagcagaacacgtgagaaggcctggcttcagagcatagggaccaatgaacaggaagctttcaaagagccacaggtagctggggcagttggccaattaagcttggggtacccatgaaatgggggacactcagataaacaaatttcagataaacaataactaatagtttatgtcgcaaatattgcatagggcatacttccactaaaaaaaatattgtctaaacataactgaatctttcttttctttttttaaatttcctaaatctagtaacttccatgataggtgaaggtctgtgagacacctctgcatgactacacatttcttgggctcctgggagaaatgtaaaagcttgtcacttggttgtgattccctctcgcggcccgcaggcctgctctattgacaatgcctaacagggagtcattggcaatgaagaaatgcagagtatggcaaagtagctatgggctggagatgcagctccgtgatggactaacgcttcaccactgtagaggtttaaatgattgctctggtcacggacggcttataaagcactcgggaatcggtggctcttggcttcatgtggtttcaacctgactctaaatttgcaaaatttatggtttggttgtttatagaaagatgccattgactgattcttatccatcatttcaaaccaattacattagatggcgacaggatggtgaaaggttggcctttgcttttgatattatattcttgaaacaataagtgagttaggatcgccaagctgtcactgagacctacagaggcataggaaggaatccgtagccttgtgctatggaaaaaagactcatatacctcaacaccaaagatgcagatactgatgggcccaggtcaccagtagactaatctttcaggaaaggaaaaacccatagggaagtagcataggatgtgaaaaaggaggacttgttcttgcctgcaatttccagcttataaaaatgttctctcatgtcataagagtcccatataccaaggcttcacacaccttgtcaacatgcaaattttcacttgaaacttttatggggccttttatacaaatatataaaacaagtatagaaataaaatattacttatcatgaatcacaaagaattttatcttaaagcaattctttggtagccaaataatttttccatttattaaagacagaagcaaatttacatgctaatgagatggacatgcctaattttacttataaattaaatttcagctaaatatttgatacttcaggaagtgagcaatttcctaaaagggttgatgaatattttgattttataattgtcagttatgagaaagccacttcacataaatatatagcacaaaatgccagaaacatgtttagggccatctttgaaattctgccctaatcccaagccaaaattgattttttttaatgggactcaaattagcaacttgaacagcaatttagtgtctctgtgtatgtgtgcttttttacttgtatgtgtatgtggttgtgtacttgtgtatgtgtgtacatgtaaaggatagaagtcatcctcaagtcttgtctctcaaataccacctacctcatgcctattagcaaaccactttatcaattgcactatttccctactctccaaacagcaatttttaaaacccaacattttcacactatatgatcccaagatatacaactatgttgatgcctacatgctgaggcctggcaacaggaaactattaaaggtctctgttttctttaattaaaccagtatatttctataagcataggaaactttgcatgtacagtagagacactgcaattcacagctcctaatcatctcagatctgagctgaagcgtttcaggcagtatttggtgggggtgtactgtgtcatgggatagtatgcatagcaggaccactgtgaagtcacatgactcaggaacatactgccaaaaatatttcacatttgttgtacatttgattttgaattgatgttcaaccattgtgcgttcagagagatttccctgttgccaaatttttctaagctcccacactcggttatgccacctgatggagtcaccatacacagcataagaagctgtttacagaagccatatggggtggtgtcctagttagggttgctactgctgggatgaaatgccatccccaaagcaacttgaggaggaaagggtttatttcagcttacacttcctggtaatagttcatcactgagggaagtcagggaaggaacctaagcagggcagaaacctgagctaggcaggaacctaagcagggcaggaacctggaggccccagatgatacaggggcttactccatatctctacactggggaatatagcatggaagcagacatggtgctggaaaggtaggtaagctttctgtaccctgatccatagcagaaagagaactgggactcacacaggcttttaaaacctcacaggctacccctagtggcacacttcctccaagaaggccagacctcctaacccttctcaaatagtgccactctctggtgactaaacatgcaaatatatgagcctattggggggcattcttattcaaacctctgtaggtggggtgaaaaggagaagactagccaatctcaacctttataaaactaagattatgtatagtaatcatttgaggttttcatacatgtacacaatatattttgagcaattcaccccttgcttctcttctaactcctcccagatctacccgtttcccacctcctcccacctttgggtcctcttttgtgttttataaccttactcagtccagtttgttttgcacatattacacatattccattctagaatgttgtctggtttgaccttgttcaggtcttatgcaggcaactatgactgctatgatgtcatgggtgaagtggacctgtcatgcccagaagacactgttttaaatcagtcctccttgaactctggctcttatggtcttctgcttcctcttctgtgatgctcactggtccttggggaggctgtgtgatactcagttccatccatatctgagcactcgaaagcacttactgtctaaattttgatcagttattagttacaaagaactaccttcaaaagttgcttttgactgacaagcaatatagtcagctctatgattagaaaaaaaatatacttatcacagattcgttgaaaagataagtccttaaatacagctagtcactggattggagctaacactaatgcaaatgcatgcatgctttttctccaggccaaaagggggtagaggggtggggttcaaagaagacaaaatgtagtgtgtaaaatatttcaggagcagtaaggggtgggtacctagttttcagttttcttaacctttctgccatttgtgaccatccatattcatacactcaaatgcaaatgatgtacaccaaccttgcagatgtgagcaggtagaagaaagagtggggattcccagcatttttggtgagacttgtgtaatccaaatgaatgagaataaaatggaaattgctggggggaaggatcgtctgagtctataataattactattttcacttcaagggtttcagactggaacagcatctcctgctaactgcttcctgtattagcaatctcttactgcacagcgaatcccccaaagcttagtggctttaaacaataataaacatccattaactctcatacttcctatgggctgtgcattcaggagcagttttggaccagtagaatggactctcatcagacaagaggtgagatataagctggatcccctggtgaagcctctgtggggtgaggagaccacttgaaagggcctcacacacagggtttggattaggaggaagggtcatcctttccacacagacctcttcaggaatgctagagtgttgttgggacatggcagtagctatcctcacaataagccatctaagggagtgaacggcaggcagaaatgtccctttcatgagttgcattgggtatatgttgcattatattgaccacactttttttcattgcaagcccttggctaaacttagctcaaattcattcatggggaaaggaattaagactccatcttttgaaagcacagtgtatgccttaactggatcctgctgctgttacaaaatgcctgaaactaggtattgagtaaagaagataagtttgcttcatactcttctggagtctgaaagcctaagctcaagcactgtttgtaatggaggccctctctcttcctctatgatgctactgattgcagcatcctctgagggggatgaacgctgtgtcttctcactggatgggaagggatagacagccaaaagagggtcaagagatactcttaagccctttttgatgaccctaatttcactcttgaaagtggagtcatctaatttttaatttcctttaaagaccccacttctttattttctgcagattttttatttgaattagaaacaagattgttttacatgtcaatcccagttcccttctccctcccgtcctcccctaccctcccccaactaaaaccctacctgtcacatatcctttctgctccccctggatggtgaggccttccatagggtgtcatcagaaagaccacacttcttaacactatgacattgggattcaagactcaatgtgaattttggaggagacacaaatattcaaaccatagcaatatgtcaaagatttgtgagcacacttttttaatgcttgatttacaaacagatttttgatactttcacatgccaaataaaattcccaacttaatatatagtgtcacaggagaaggtgactggagattggcaattccagctactgagccaacaaaagcttatcaatacagactgggaatttgaaggttcacagtgctaacaggtgagaaaactgtcagctttgtggtacaaagatggggaaagcaaacaataaaggcagcaccaaagcaccccaacacactctccctccccagacgaggctgatttgtaactttatgccatctgttggtgttagtggtgtgactttatgactaactgatagctcataaaggaccctgcctacagctgaggcgggacaataatgacaaggacctcatcacataatctggcagtttccactcataagaaattaccatttcatatagatctaaacaagtgtccttttacttgtggccaaattctctgggctctccagacttcctgaaaacccttgcatatgctactgtcttcttattaaggaattctaggcaagtctgaggtcagagtccttgtgccagactttcagcaaaaatacttttacctctaatagctttagttaagaagatcttgcctttgtgaagttcatttgtactagtagggaaatttgacggtatattttttaaatacagtataggacagggagataattttacaaaacaacaaatcttgctttcagaataactgtatcatgatgtgatgcaaggaccacaaaaatcaaaggattctgtgcaccgctgatgtgtgcatagcctcaggaaagttactttttgattcttgatttccttagatgcccaatcaatgagaattacattaaggtgttataattctaaggtgctgatcaggtaatacttatcactgtccacaaaggtctacaaaatggtgttctatgcatggacatgaccctctctataaaaggagtgaaagctattccaaacagtacttgagaaataaccaggcaatctattatgacaacattgtccttcctaacactgttcctcctaggccttctgtccctttctaccgtctcagtagtttctaagactccctgaggacccaatgtcacagaaagaaataccagtttctccagagccatcccagatagccttgccagtaccctctgtcttctggggcatgggggggttgggtggggctattgaaatacttcacaggagaaaagtaaggctcttcccaaaggagaggtaaagattgtttttaacatatttagttagtcctgtttgcttctcaaaataaacatctttgtgctcagttaaaagctttccaagatgttacaaggggaagggaaactcatgccaaaagcttaagcccagccagacaggaatatgaaaattttgctgcctgtggaaacacgtgaccaggcaggactttggcataaaaagctgtcatgtgtgcttaaataaccacagtagagtcttggggtggctcagggtacacaggcacagttgggctcacacagcttctttgatgggtccattcaatgacagctcacagcacacacttgactatttatagaatgtacaaatccaactagacaaactctggttttgatggctggagaggcgaagagaggctttcctctctctcttctcctggttcacattcggattccagttcttaacacttgaaaacggctttaggaaatcaggtcctaagagtctgactacagttttataggattgtgaccttaggtgtgacatcctcccctgggcaacaactacctcctccataaaatagtaatagtagtgcttcctcaacttaccaacatgttagctttccatcattacagcaaacacccaagacaatcaattttaaagagaaaggttaaacccaatagtagcagtgtactgctgtcatcccagagcttgaagggtggagactagaggatcaggatttcaaggtcatcctggactacaagagaccttgtctgaaacaaacaaaacacgaaaaagcaaacacaaagagaaaaggtgtattttaacacgtaattcacggaattgcagtgtgtggtaaaggggtccacagctggggcttgtagtgtgacactggcatcatggtgacagcatgttccagagcaaagcttcacaccatgaagaagaaagcaaagagaaaaggaaaagagaaaagaggaccccatgatccttgttggaggcataattccaatgacctaaagaactcctgtatcttaaagattccctaactcctagtagcaacctagggtggcccccaagtatttaatacatgggtctttgatgggacatgtaaaagatccaaactataacactttacaagattgctgagacaatcaaatggaataacaccagtgaaaacactttgtacattacaagatgttgtataaaatacaagctattattaattatctggggtttctatttctttgttctttccttggcctcatttgtttctgtgtcctttagggatttttactttttttttctaggtccaagattatcaatattgttcgtgcttagttgcttgcacaggagctatctatcaaccactcaaatctgcatctatacatggtctatgcacagtcgcattctgagacccatctacaatcagtacagcctgatttacaccatcacttgtgtgtcaaagactggatgactctgggtcatatgctggagatacaggacataccatcagatctaagccttccataactgtcagctatgtgaatcaggtctagctaatctgcagctgagtcagccctcccaggcagacagctctggtttctcagtgttcaggtatatctggacactttgaggcaaaagttggaatttgatgttctttagccctgcttttgtgaagaagacaggcaccatatccttaacataacattacctgggtatcactgcgttggcttccacatataaacattacctaggtatcactgcgttggcttccacatatacctgcctcctcctcttaattcaatacctaatttgaggctgaagtgtttctggcattggattccatattaggcaaagacagctgatttcatttacattcacacagcttgactattaagacagtgagctgaggccccctgtagcaacatgacttactatttgttttaggaaattcttgcccaggaaaataaacttgtagagcaataaataatttcactgttcccatcaggaaactcctgagaaccaatttatttgaacaataaatctgctcgtgcggtcaaacagcctcttctcaggacaacggattactcacctgggtgattggtttacttattaagcaactgttcacttatcaaaaatggctttgagaacgagagatgctgctcagttggtagagagcttgcctagcattcatgagaccctggctctacataaatggggtgtggtggtactcatctgtaatataagactcagaagacagaggtaagaaaatcagaaaatcaagatcattctttgctttatttgcattcaaagtcaacgtgggctacatgagaccttgtctcaaagtttttaatttcatttttttgaaaacagaatttctttgagaccctgttattactatgtctataagaccaaactagtataagcattcccaacttttacaaggtcccctctttggactcacactccaaatgctgtacattttacaaggtctccacgttaagctgacactccaaatcctggctgttccttctaagaggctctgtcaaggaggtggccccctctcttgtagatttagtaaatttagccatagttgatccaaggttattatgttgtgaaaagggcaggcagctaatccttgaaataatcttaatattgctttgtgggagtttgcagctaacaacttagtgcattaatcaataaaagaagaaatttatttttaaaaattcctttaaatgtaaaattcattgttttaaaagcaagacttctgaaatcatcattgtgtgaacaataatggaagttttttgtttcttatatgatttgggatagtttttactttaaattacatgagagatggtatatttgtaattttttttcttgcttagagtttacagaaggctccatttagtcctgcatacatctaaagatttttctgttaaaaagtgattattggctagtgtgtttgcaataaaataaccaaccaatgttttgggaatttacctgaaagtctcggacagttggattggggtcatatctgagctggtttgctcttcataatattcaaattcagctgctaacttgactctcctgatcacattgaaagctggaaacttatctaaatgtcctacatagaaatgagcatttgtggcatttgtttaaacccatgaaacagcagtcatttcaaaaaatgagttagaaagcaatctttctttttttctaacttcgtttttttttgccttttattgaaaagagattcttttcttatataatatatcctgattatagtttcccttccctttactcctcccaggtcctcccacctgccctcccttctgggtccactccctttctgtctctcattggaaaagaacaggcttctaagagataccaaccaaacatgacaaaataatgagaaggggagaagaggatgggtgaggaagacacgatggggcagggaggttgagttggggaaagaatagaagagagaaagataagagatagaccaaaacacctaatgtcctcctctgggcagtacacacatccatataagcgtgtgaccaaaaccacacatgtatactaccctcacacagaaaaatgagtaaatagctatattttaaaagaagcaaaataatgtaaaatatttaggaagaaatccttgaatttagcatctggctttattgacatacgaagtcttgcatctcatggtaagttgagtcttaattttacttcagttttatttaagataatccaaaagtggtagttattttaagtcagaatgttttgcatgcagtattcaacatgggcttgtttcctaggcaggtagtctggtaacacttacttttttgagtacctgtgatcttcaaggagaccaatatgttttcaaatatgttaattttgacaattttatgagagtattgatctcttttaaagctagtaaaaccaaaactcagaatttagtaagttactaaagacttcaggcatgttaaagtcaagacgtattgtatagtctctctgtttgcaaagctggctgttttcacttagcacactgttgcaggctctcatgcttgccatcttcctactctttttgtcctgtcattaggcagcagagaacacaatttcactctcaaaggatgcatgaaagattttgaagtaggaactgcagttcaaagttccttatatatctgtatgctaacaagcattgttacacaagcaaatcagcaaatagactaagatgtaacgatgaacaaaactttaattcctgaatttgttcattcttctcctccacttgaagaagagtttgttgggatttttgttgtcaccactctctatacactgtgatgcttagtaccataacttggctggatccagaaccacctaggacacagtcctcagtcacccctgtgggggagtatctacattaagttgaggtaggaagacccaccttaattggtggtagcacaagtcccttctttctgacatattttattgaaataatagaaaaagtaattactacaacacatacccaccttagtaaagcagaggaaattaaggcttcttcctcacccatcactagtctcatgcttgcagtgctacagaagaagacataaagagtaaacagagataagcaagaataaagtgctcgcattgatttaatatgcacaacatgggaacttttgagaagaaagaaatagtcaagaggacaagtaggcttgtgaatgtctgtgttccagtttgataaacagtagacagttgtaagaaataatatgtatatgattggcagtaacagagtgtggtctaatgataacacactgggaaagtgagcaagacctgctagctcactgtgtcttctgagagcaaactccaggcatttcttctagaatggcatctctcaaatgagggctcttacagcttgatttggagaaaaagagggagccagaaaggtctgccttttcctgctgtttcctgaagaatttcttcaacttactagtagctcagtaatcaaccagttacctaaaatgcagacaatatcggtttgactcccagcaccaaaagaaaaaaaaatcagtatgttgagaagtcataatttggggccatttatcttaagcttatggacacattacaaatgttctatattttatttttaaaaaatacatcctgtggcacaggcctttgtacccagcactcaggagtcagagacaagtggatctttgttagttcgggatcagcctcgtctacatagcaatttcaacactgtctccccccaaaaagttactttatgctgaccatgatggcacaaatctgtaatcacagcactgaggcggtggaggcaggaggatcacaagtttggagctagccttggcaatttagtgagacttgatcacaaaagacaaaacataaaaaacactttcacaacctacaaattatgatttatattctattacattttataaaatgatcaaatgaccaaagcattaacttttatgaatctactctacaaggaaagatgtttggtagttaacaacactaattgctcttacagaggacctgagttcagtcctcttacagaggacctgcacccaatatggcttggtcctggaaaccaaggggtagggagggtcttaagaaaagacagacatacatgaacagaaaagctgggatcagataggctgtgaacactctggtggagtggcaccaactaatggtagcaaccaggaacctcagtgtttttattatgtacagcagggattagctagtctgagtagacgggtctttgtggggaagccatctttggctataaacaccctggaggagaaggctgcagttgcttgttttggcacatactgatcactcatttgtaaacattactgcttggaccagaggctttgccagtttcccatgggtggaaggtgctggatccttgatgtggctgagcctatttggacaatacaacactcaggactttattcactctttacacattctctcatggcttcttacactcctcaccagttccaagcatctatcctgggtggttcaaagcctcctgtagctccagttccatggagatccaaccctctctctgaactccatgggcacttgtgcattcatgatgcacacataggcatccaggccaacgcacataaaagtaaaactcttttcatttttactgcatcttatttcctcccagagtctgtccattcaatttcattttttatgcaccttcttagatttcagggcagttctcacatcctgaaaacgttgcatgcacatctctattatcactggcatttattatttcccagcagcactcacaacagagcattcctctatgctctcctcttcctcccctgaatggaacgcttacacaaaaccaaagtaaagcttatttctttgtaaagaaatgtctgcagctttcaggaaagagacacattcatacttcgattgtcctgtgaccacccagacagcgtgagtcctggaacaggaggctccagaagaaatgccagtggatgtgaagggaagagtttccagttaaccaggccacttgggggaggttagaagacatatataaaaccagacctctctgggggctggaaagttggctcagaaactaaatgctcttactgcttttgcagaggatccaagatctgtttgcagcaccaacaccagatgcttacaactttctgttactcgagctccaggagatcacatgcctcgtctcactcctgtgggcacctgcactcacatgctcatacccactcacagacagacagacagacagacagacacacacacacacacacacacacacacaccatcaaaagacttttttgcctgcttaaaattttttgtgcttgagaacttatacatgtaaacaatgaaatacaaacatgtctaccctcatttccctccccaactgccctatactcccctaacatgccctccttcatttcccctcctgtccccttcccccaactagttccagtgagtgccatggaggccatgcactggaggtaggaaatccaccagttgctacatgctcaaaaaaaaaaaaaaaaaaaaaaaaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaacacatctcaacttcaaagaaactacctgctgccaaaagctcctcagtaaggggtgcgatctggggatcacctgtccatccatgccaggattttggctggcttattcttatgtagggcttgtgcaagttcaacaagaaagcaaaacacatggtgtttcttgaaacaagaagcatccctaaagaactcaccacataaaacaagtgatctctggatatttcttttagtcagtcagaacaaaagctcctatgtctgttctctattcttttcttccgtcatcccttcctttctttatttctttttttctctttcccnnnnnnnnnntttcccttttttgagatagggtttctctgtgtagccctggctgtcctggaactcactatgtggaccaggctggccttaaattcagagatccacctgcccctactatccaagtgctgggattaaaggcatgttccaccaccatccagccttatcactatgctggtctatttttctttagtagatttattcttctgtggcagaatacctaaacaatagccttctgggtataatttaagttggtgcttgtaaacctgtctagtggacttccaatgccaatgtcctagaggctgaggcatgaagacctctagacagagccagctgggctacatagtaagactgcctcaaaaggtaaaaataagggggcatatcccagttcatggatggagtcgcaggtttgatctcagaactacatacacctggctttgattacacctgtcatctaagcaatggggacctgaaaaagtaagaggatcagaggttcaaagtcatgctcacttatttggcaaatgtcagatacgggagaccctgtctcaaaacaactgcaacaacaaacccaataaatttttatttcattgtcttaatttttaaactgtgtatgtacccatgtctgtgagtaggtatgcacacatgcatgcagggcatcagattccctgcagctggagttacaggcagttgagagttacctgattagctggaacccgaactcaagtcctctgcaagagcagtgtgctcttttaaccattgggccacttctccagcccccaaaatggtgtttatgaataggcaaaataaatacatctgttattttcaatgcacgtaagcattgaaacaaagaaataaccatctgtttccttatctatatactagtacttctgcctttttagtgtttccctattattttttctttccttgtacattttagatatttcagtagctaatgtgattgtggggaggcttaaggaagtaaaccccttaacaggagtaccttaagacttcccaaagttcagtcctctgcctgccgccagaggtgagtctgggcactgctctgcccccaacctcacccatcaccccctgctgacttcttcctgagcctccccctggacaagactggacctgcccagactggaaggcccaccgtaactctggacggacctcgcccttgtcctccctctgccctctgccctctgccatccacctgcctcctgagagagggagagaccccacctgcacccactggaagaagggatggaaagatgggatgggacgaagggatggaagaagacagaataagaacacactcaacaacagaaagaccaatatgacaccaccagaatctagggactccacaacagcaagatctgtaaagcccaatgcagaggatgaggaagagatggaccttaaaaattatcttatgaagatgatagagaccattaaagaggaaacaagaaaaccccttaaagaaatagaagaaaaaacaagcaaaaattacatgaaatggaggaaaagacaaaccaaaaaattcaagaaataaacaaatctcttaaagaatctaaagaaagccaagaaaaaacaaccaaacaagtgaaggaaacaattcaaacagttcatggtttgaaagcagaattagaaacaataaggaaaacagaatgaggggatgctggaaatagaaaagctgggtaaacaatcaagaacccctgatgtaagcataaccaatagaatacaagaaatggaagacagaatcttaggtattgaagactcattagaggatatacagccatccaccaaagaaaatttcaagtccaacaagtccctaacacaaaatatccaggaaatatggcacaatgtgaaaagaccaaacctaagaataataggtatagaagaaggtgaagaaattcagctcaaaggtacagaaaacatatttaacaaaaaaactcatagaagaaaacttccccaacctaaagaaggatatgcctatgaaagtacaagaagcttacagaacactaaatagattggaccacaaaaagaagtctcctcgccacataataatcaaaacaccaaacatacagaataaaaaaaatattaagagcagcaaaagaaaaaggcaaagtaacatataaatgcacacctatccaaattacacccaacttctcaatggaaactttgaaagccagaagatccttaatagatgttttacaaacactaagggaacatggatgccagcccagactactgtatccagcaaagctttcaatcactatagatggagaaaacaagataatccatgacaaagccagatttaagaaatgcatatccaaaaatccagccctacagagattactggaaggaaaactccaatgcaactaggataactacactaaaaaaaccataggcaatagataatcccattttaccaaaaaccaaaagaaattggggaaatccacacacaataacaccaataacaacaaatccaaaacaaacaagaatcaccaatcaatggtcattaatatccctcaatgtcaatgatcttaacttgcctataaaaagatacaggttaacagaatggatacaaagacagaatctatccttctgctgcatataagaaacacatctcaacttcaaagacagatagtacctcagagtaaagggttgggaaaggattttccaatcaaatggacccaagaaacaagctggtgtagcaatcctaatatccaacaaattagacttcaaactaaaatcaatcaaaagagatgaagaaggacatttatacttcacacaggaaaagtctatcaaggtgaagtctcaatcctaaacatctatgccccaaatacaaaggtacccacattcataaaagaaacattactaaagctcaaataacacataaaatctcacacacttatagtaggagatttcaacaccccactctcaccactagataggaccatcagacagaaacttaaaagaaaaagaactaacagatgttatgacccaattgggtttaacagatatctatagcacattccatccaaacacaaaagaatataccttcttctcagcgccacatgggaccttctctaaaattgaccacatactcagcagcatagcaagcttacacagatacaaaaaaattggaataaccccctgtatcttatcaaaccaccatgctttaaagttaaaattcaatagtaacacaaattgcagaaaccctacaaactcatggaaattgaataatgcacaattgcactatttctgggtcaaggaagaactaaaaaaagaaattaaagactttctagaatttaatgagaatgaagacacaacatacccaaacctattagacaccttgaaagcaatgctaagagtaaagttcatagcactaagtgcccacatgaagaaactggaaaatagtcacaatagagaattgacagaacaactgaaagctttagagcaaaaagaagcaaactcaccacggaggagtaaatgccaggaaataatcaaactgagggctgaaatcagtaaagtagaaactaggaaaacactacaatgactcaatgaaacaaagagttggttcttcaagaaagtcaacaagatagacaaacctttatccaaactaaccaaaagccagagagagagcatgttaattaacaaaatcagaaatgaaaagggggacataacaatggacactgaggaaatccagagaatcatcaagtaatactttgaaaacctatactccacaaaattgaaaatctaaaagaaatggacaagtttctggatagatattacttaccaaaattaaatcaagggcagataaacaatttaaacagacctataaccactaatgaaatagaagcagtcatcaaaagtctaccaaccaagaaaagcccagggcccgatggtttcagtgcagaattctaccagaaattcaaagaggagctaatatcagaactcctcaaattgttccacacaatagcagcaggagggacattgccaagctctttctatgaggctataattcccttggtccccaagccacacaaagacagaaacctctgactatcaacttccccacatatggtttcaagatggtttgcactcaagagtcagctccgcatggcaacagactttttatcccatctcacactgaattgaactccgtcttctctatagaaactgtttgccttacagctttctttatctacattttacctccctttccttgacccaaaacatttcttggtccttgactcttccttttgtcttccatctcacagtcagactaccaggaaacccttcaaagtgcatttgatttgattgctatttccagtctctcttggaatttggagagatcaggaataacaggaacatacctaaacgtgataaaagcaatatacagcaaaccaacagccaccatcaaactaaatgaagagaaacccaaggtgattcctctaaaatccagaacaagacaaggctgtccactctctccatagctattcaatatgtctttgaagttctagctagagcaataagacaacaaaaggagatcaaggggatcaaattggaaaggaagaagtcaaacgttcactatttgagatgatatcattgtttacataagtgacttgaaaaactctaccagggacctcctacagctgataaacaccttcagcaaagtggcaggatacaagattaactcaaaacaatcagtagccctactatatatggatgataattgtgccgagaaagagatcagagaagcatcacccgttacaattgctacagacaacataaaatatcttggagttaacactaaccaaaaaaagtgaaagacctgtatcataagaattttgagtctttaaagaaagaaagtaaagaagataccagaaaatggaaggatctcccatgctcttggataggtaggatcaacatagtaaaaatggcaatcttgccaaaagcaatctacagattcaatgcaattcctatcaaaatcccaacacaattcttcacagaccttgaaagaacaatactcagcttcatatggaaaaacaaaaacccaggatagccaaaacaaccctgtacaataaaggaacttccggaggcatcaccatccttgccttcaagctctattatagcgccatagtcctgaaaacagcttggtattggcacaaaaatagacaggtttaccaatggaattgaatagaaaactctgatattaatgcacacacttatgaacacctgatttttgacaaagaagctaaagttatacaatgggaaaaagaaagcatcttcaacaaatggtgttgccataactgaattcggacatgtagaagattgcagatagatcatatctatcgccatgcacaaaacttaaatcccaatggatcaaagacctcaacataaattcagccacaatgaacctcctagaagagaaggtagatggtaccctcaaacaaattggtaccggagactgctttctgaacataacaccagtaatacggtgtgatttatgagcccagtggtaggtacccaggtgtctctctgctcatgggtcctcatcaagaagaattcagaaaggctcgaagaaggcagtgagttagacttatcagagcgaaggaagattacactcagacagatgcaagggatccacagggcccaccctttgcctaccccatctattcttattcatagcatcttcatctgccccttttgactcgaggtcttaagaacattttggtctagaaagtatctattcctttttgagattgctccagctcttgtggttggtgtcatggcaggttgtctcaagcttaatcttctacatagcagggtccgatgaagatggatggatacaggctttcctctcaggtaactctaggctgtgtcagtttgacaaccaacactacccatgccactttccttctcttccctttttatttctcctttgtttcatcccattgctggtgtgagtgcaaacttgtacaaccactttggaaatcagtatggcagtttctcaggaaaatgggaatcagtctacctcaagatccagcaaatcctttcttgggcacatacccaaagagtacacattcatacaataaggacagttgttcaagcagtttatagcagcattatttgtaatagccagagcatggaagcaaactagatgcccctcaactgaagaatggataaggaaaatgtggtacatttgcacaatggagtactaatcagcagcaaaaaacaatggaatgttgaaattctcaggcaaatggatggaactagaagaaaccatcctgagtgaggtaacccattcacaaaaagacaaacatggtatgtgctcactcatatatgatttttagacatagggcaaaggattaccaatctacaatccacactgccagaggagctaggaaacaaggaggaccccaagagaagattgcataatccctcgaagaaagggagggggacaagaacccctgaacaaagtgggagtatgtggtgtgggtggagaggaaggaggtgggaagggaagaaggggagggggaaggagaacaagaggattgagacaggggaggaatagaggagggcaagaaaggagatgtcttgatagagggagacagtacaggtttggagagaggtctggcacaggggaaatgttagtggatccacagggatgaccccaactaagaatccaagcagtggtggagaaaatgccattgatgcccttcccctataatgagattattgtctaccttggttaccattcctagagccttcatctagtagctttttgaagcagaaacaggcacccacagctaagcactgaaccatactactggaattcagttgtggagggggaggagggatgagaaaaggagccaagggaaggctggagagacttgcagaaacagttgacctgacctagtgagagcatggagactttagtcataaagctgtggaaacagcattggaccggaccaagccctctgactgtgggtgccagctaggaggccagggaagtctatgggacctctaacagtggagccagtctttaaccctagagcacaatggactttgggatcccattccctatggagggatactattgcagtccagatacagcaaggagggcctcggccctcccccaaacgatatgacagactttgaaggtccctggtggagggccccactatctctggggaggagttgggggatgtgatgggggtgttggtggagaacatgagagggtgggagggcaaggaaatgggggaatggatatgtaaatatgagtagtaattaaaaaatttaaataaaaaagacttaccaaagttctaagtgttcattaataatagtgttctgtatttgtgtcactggaaacattcatagtctataaaaatggccagtaactctgttcatcaataaatgacttacacaccaggaactcttgggcagtggtagatgtagcaatatagggatgatctttcctgtgaaaacagtggatgggacatcaacaagaagggaacagagcattcccaagtaatgatggataactgaaggccatgatgctagacagatgaccatcttaacctgaatagtcacagggtgtctttaaagaaaaagtgtggcagaatctttgaccaggaggaacactttaaaaatctatttagtacttcagaactcttaccttatatagagacacacatggggactgggaattcatgaaggagtgagtgtacatacatacacgtgtgtgtttgtgtgtatgatggagagaaagaaagagattaaagcttgttggcacaagcatacaactgtcccaaacaatacctgtgcaagggtaacctggaaggaaatagcttggcattaaacagctctttgaacttattaaaagacagtgagtctttttcaaggaaaatgcccttgggtaacacagagcctacacacaaggtgtgacttctcttctcacagtcctggtgcagcagggcaccctgtggtagctgccctgcttcagccagggcagaggagcaagtcttctaaggtaagacagacttccttcaggtgcacacagatgactggggtaccttgcatgtacttcaacatgaagcagtccttactgttctgggcaagaatataacagaaaatctaggaactgtcaagcagtctcttccaacaagtaggttttctgaaaaggggaaagagcaagctcacccttaaacagtttcaatgggtcataaaaatgagaaacaaaggggttatgaggtgcagaaagagaaaatggcactgatgtctgctcagaggtacaaatcctataaatagtacaccggagcaggattgtttgaagtatgacccaaacagtggtctgagaagatcgtgtcttttttattataaaagaagacaactccaggtgaatattgacatgtcagaaactgaggcaaagtccatctctttgttttactttttttaatctgtgtttaacttttatgcccaagacaacatcaaaattccaggttgtactcatgttctaggtagttctgaggaaaagggagaaaaaggggacacatgcactgagagcagagatatttgggagccaattctacaatggatcagctttgtcatcttggcagtttccagctactgcttactgtttgctaatgattcgggtaatattcgttagaaataaagaatccgacggtccctggtgtaggagaagtctttaggaaatttgattctcctttattctcttacaaacagttccctgtgttctgcttacccaagatcttttattcctaaggtgagcttagagtttaggtattcatctccatctttcctcgcccattctccaacaacctaagtcgatggctacatagcaagtttgaggccagtccaggatacataagccaagctgctccttcccctacactcctgctcctaggaggccattggaaaggtcatttggggtgactcatccaaacaaacactcctttcaagctggacagtcaaaaaccataaatggccaggctgccatgaagttttggtatgacatgtgatccaggggttgttttttgcaaagagtatgttctcatagctgaaaaggcatggcatctaggaggacatcctccagcttcagtagagagaccaggcccttttttttaaacaagtcacttggaaaacagcagctctcctgcaaagaccttcctgttgccccacaaaggagtgtctgctaccttctccctccaggcagtgtcttttggacctggtcagagcaagtctattctcctttcttcagttcctggttcttagcctgtgtcacatacaacctaggagcccacgccacaggtctgcttattcagcacagctgtctctccagcccctgctacctgagtcagcgtgtgcacaacggtcacttgactctttttttttttctttgtaaaaggaaaaggcaaaaaaacttggtggcttaaaagtagaagtgtcaagatggtgttacaattatagcaccaaagtctggaaagatgcctcagacggggaaagtattaaaatatagaaagctggctttctaaaatagctttatggcaccgatttaaacgatttggatttctcccctttaaagtttattttactttttcttcttttgattgtaatcagtcatctgaaagacaatgggaaagagccttgttagtgtaggtagctggcatatcagtcttccaaaaggcatctggaggacgcctttcggatccgaaatgtctctcagggctattcgttttcccttttgtgtgtgtgctggggactgaccgagaggcctttgctggtcatgggtaagcattccatctctgagctactctacacccccaggcttaaggagaagaattttttaaatgagctctcaaaaggacattaggaaagaaggggacggaagggacttcaagtacgatgattcagaaagtagctgtatccacgtaagaaggtacaatactccagagctgaaggccaaggccatttccctgacaggcttgaaaacaaggaaaaagaaaattaggcaaccctgagtcactgcaccatgaaaactgtcacccaaagccttttttcagcattgagaaacgtcaagggtatttctaagttaattggacacaccatgaggcatggcagtcccaaacacttccctttgaaagacttgggattgatgtctttgaggcagtgccttcatgaagatctttaatcttcagcaaaaatgtgaggtaagctgtatatcagttctaatttttagagtaaaggtttctgctcaggaaggttgctaatggaaggagccacatcatcttgagacgcacagcagcctggaaacctacctggctagctacttggccagtgtgtgaaacatgaagagcttcgtgatgatgttttctccctccatttccaccaccctcattaatgaatgccacccgccatgaaaaatgcacgtcttctaaaggagagaggcaggatcataacacagctagacatttctcctgacttcgtattagcatctgcagctcatgtgtagggagggtttcccatttttccatgtaaatatagccttccaaaaattctttttttgtcccatgcctacactgtaaagagataaaagtttagtttaaagttcattcttttaagtttatgtagccaatttgtgagcatgtgtgttttaacgatagacaattcaagggctagtgatggtgcaggaagaggggaaggtgccacagataattgaggaaggcacctcagtgagaaatgagtctatgagcagaagtgtcaggcagttcagccagcaaaaaggcagctgtaaacagccctggcagagggcaggtttgatatgcatgatgttgtttgaagtacctgcagggtatcaatcaccctattcagaaaaactctgtgataaaactacctcaaaggaaactggcaaatttgtctaaacagaaagacttcattcagcatactgaaaatgcagtaacgtgaatgacaggacattaagtcctggaggaaaacccacgctgatcatcattcatttagcaaagattcatcagtatctgtttaagtaccagatactgggaagtcttggcgttacaaagatggataaaataggtctctgcactgtgactcttgggtcctattgaaacaaatgccttccatatatactcaacagatgtctacccataggtgtgccaaggacactgcagatatttggttatcgctgttcatgaaattctgcatggaaaacaatagcagtgagaaccagaaagcacacagcaaatacttctcagcaacagaaataacacggctaccaggctgcagctgaatgctacaaactgtgctatcctaagaacttcacactacatgggcctatttacataacatttaaacatggcactagagcacagaacttggctttcagtaaagatgaggagtaatgggttagtgaggaagaaaatgggggctgctgggtgtgatttatgagcccagtggtaggtacccaggtgtctctctgctcatgggtcctcatcaagaagaattcagaaaggctcgaagaaggcagtgagttagacttatcagagcgaaggaagattacactcagacagatgcaagggatccacagggcccaccctttgcctaccccatctattcttattcatagcatcttcatctgccccttttgactcgaggtcttaagaacattttggtctagaaagtatctattcctttttgagattgctccagctcttgtggttggtgtcatggcaggttgtctcaagcttaatcttctacatagcagggtccgatgaagatggatggatacaggctttcctctcaggtaactctaggctgtgtcagtttgacaaccaacactacccatgccactttccttctcttccctttttatttctcctttgtttcatccttcctgggatatctcagatgtcttttcatttttctggtactctgtcaacatttctaacaagaccttttttggaaagatatgatcaccatattatcagcacacctaacaaaattaccattagttccttttcactgggacacactagtttttctagatatctttcatccagaaaagttttctgtacatttgtttgttatggcttcttttttaattcctaagagcccatctttttttttctttttatacaacaatttgttgtagaaattagcttaaaccttttactgagaggtccccctcctaggcctggtatgctgcttttgtttgctgtttgcttgtttagagatgggtctcatgtagcataggttggcctccgactcactatgtagccgaggatgacctcgaactgctgattctcctacttatacctcctgagttcaaggggctggagttataggaatatgcctctatgcccaattttctggggtgctgggagatccaaccaagactttgtgcatactaggtgaccattctactctcaggggtacatcccttgctctccttctgaccttgaacttgaacctctcctatgctgcttcatcctacagactcgggtccaatttcagatttagtcatacatccatgtcaagccttaactctacttactttaatatgctttgagactttgtatattttctttccacatctcttagttttgttttggttttagtgtctattctatatagcacttgactttgacagtggcttcttaatctgttaatggttacacagacacatagtcaaccaaaagagactaaaacctccaaggccaagttccagatccttttcatcccagaatgtctctgggagaagactccttttctgatttctctcatgctcagaatcttttcaagtcttgcagctgtcttggaagatggactgtgctactccttctggaaggggtgtcagaaaactcacagcagaggcaacactgagccattgctacaactgaaaatcctccctacaattctataacactttgcagtgtggaccaacacccagtacaaagccaactgaaatcaactgccgagtaattgactaccatcctgctaactctcatacagttttgcaagtcagcttgccctattttcattgtgatggtctgaccactatagctctttggtatgaacatcctttcttccccaagactagcaaaaaagttaataattattgaagttagataatcatgggcttcaatacaataatctctcttttaaaacaaagtaataaaactggaaaataattaatgctttcctcacacccgagtcacatatccagaaggtaccaaaagcttgagttgggtcactgtcacattgagtccttagaagctcttttgactcgatggctcaaacaagctcctgcctcttctggtgcacaagaccactgcatttgatgctatttattacagctgaaccttgttcatgtggtctcagcctcggctctgcggaagcccatctgttatcaaagactctgcatgctttatgttcaaagcactcagcaatagctagaaagccagtactgtcctagatcaggggaccgtcacatcacccagaagctgagggatgattacaaggcacctgtctgagctctgcatggttctgctagagggaagcaaaacactcgtcaggtacacttttctcaaatgaaaattggcattgtgcatgcaactgaggcctttaaagaaagatgaacacattgagaaaaaggtcaagaaccttaagaccagtgtagaaaggacgcttctgcaccactcgggatggatgtcagagaagaggaacaatgacaagccactgtcagcaatcctgtgattcctgccagtgactatttcttggcatctggggttttcttctatattcttttgagtgtttttaactcttagccttgttttatctatttgtatggatatggtatgtatatttgcatgtacatatgcattcaggctgcatatgcaggtgttcatctgtgtctgtggagaccagagatcagtgtcaagtgtgtgtgcgtgtgttttaggcagtattttttgtgaactcagtagtcactgattggctagactggctggccaatgagctctggggatatgcttgtctctgccattgctgctacctatggtcatggacacacaagacccttcccagctggggaatctgaactcaggttctagtgcaaacacattatcaactgagctacccagcccctaactattatcctataaactactttattctgttcatactctctttaaaattatgtacctttatgctgattaagtctgaggcaaagcgtctccagaattctagagagcatttcagatccaagttcagcttccgaatgcctagcatataattgcatgggaacctgtcaaccacaaggaaacaatatgtcaaatgtaaaatgggcccacttctggaaaaacaagcaagaaacaagtccatttccataccaaacaagtccattactgatgtttaagaacagaaagatcagcccagctatgttggcacatgcttttaatcccagcactcgggaggcagaggcaggaagatctctgtgattttgaggccagactggtctacagagtgagttccaggacagccaggactacacaaagaaaccctgtctcaaaaatcaaaagaaagaaagaaagaaagaaagaaagaaagaaagaaagaaagaaagaaagatcaaagatcaagtgaaatggaggctattacagaatagaaagacttccaaaccacaaagaaccaatcctggaacccagatttaacccatccgactgcatactcatttagaaaaaagcatgctgcatttccattggttggttgtcatcacacaataccacaaaggtgagtactgagctacttaagtcacactgtcatttaaaaggagtaggaaacatggatagcttaggtgtatgcttactgtttgttttcctctttggggtagagagattctgaacaagaaaaatggtttcttgcatgccagatgaaaaatgactaagtgccaaggcaggtgataggtcctgcctgttgcctcatgtacaatatcagttgaccacctgcatcatcagtcaaggtgcacacagtgtcgagtgcccatctttcctgaataatcatcatggtaaacaaacactgtccaggagcatttgtggttagagctgcagtgctttggtctatgaaagatggaaattatttgaccaaatcgaaccctgtgttaaaacgccagggtagtgaaatggcggaggaggtaaaagtgctcttcaaaaagactggtgacctatgctcaatgcctgggacccacatggtagagaagagactaggctctccaaagctgttctctgaccttcacatgtgggccatattatgggtatgtacacattcccacatgcacatacaaatatacacaaattaattactaattaatttttaaaaattgggaggaggcatggcttgacagttcgagcacttgtttctcctctagaggatcaggacccatactgggcagctcacagccatctataattccagctccaggggatccaatgccctcctctagcttccatgggcaccgagactcatgtgacacacagacataaataaaagtaaatgtttttttaagcagttttaaaattctacatgtctttactttggactgtaaagaagtatagtttcccaacattttcacttaaatgagtacacgttgctaaaattggatgttcaaggttacagttcatatttaggaaagagcctgagaccctggattactttttattgtatggtatgaaaatcctcatgttgccagttagaagcattttgagaaagcagtcactactgatcaaattaccactgttgtcatttatttatctgtcttcactctcttccatttcctccaatttaacctctgttggtcatatttcagagcaagtttaatagttttttttttttttttaaaatgtatcccattggcttatattttaactctgtatttatttcatcgttttacatgttacgattttcggcacacagcagcagggacctatgggctgatttttcctgtgcaaaaactgagaaattcgagattacataaaccacttcctctagagtcttaaggcagctgaatgccttgctatgtataaccagcatatgtgtgtgtacatgcatacatatgcatatcaatatatgcattgatacatttgccttagtgaaatcttcgggacctccaagaagaaaatctgatggggagtttggggactcttatcagagatggaagcttttggtgaacttaagctctggcaaacaaaaataagagaagagcagagaattgtttcctaataccatcaaagaatagaggagagatgggaaaatagcaagccccattttgtttatatttcaataaacaacagacatttgaaaaattaaccaagatcttcataatatttatagctttgcagtgtgtgctttgttgtttcatttattgcactgtaattcttaaaatggaagggctctttgcagcagaggaaataggagaaatggaaacatttattttatgtgtacccaaaggaagaactctgagcgtgggagaggtagggcaggtggaaacagctgcagaaaagaagccctgagccaaaccctaaagatttggggtaagaaagtgatgagggtttatggccaaaacaaggagtgtgcttgaggaccgggaatgcagctagttggtcgagtgcttacctagcatgcaaaaagcaaaaagctagggtttggttcctagcaatgtgtaagttggatgtgatggtgcacacctgtaacccagcacttggaaggctcttcagaaagttttaggcaagcctagcatgcatgagaacccgcttcgaggcggaggagggagaggaaactcttcacccatttactcattgcactctagactctctggaggtttctgtgccctggccattctggggcaaacaccctgccagctagtgtcgtaagttaaggtggtgccagggactaggagctgcaaatgccccaggtgtttattgtgcagtatcagggtttagaaccactgaggtaaggggttttccttaataagttttttcttgcagggtcagcttctgaagatgtttcgaggttattatatgcaattactatagcctgcctttatgtgagtaatgacctctcagctctctgggccagtgtctaggtagccctcaaggatatgaaacagaaaaaaaatatttagcacactcaaatatttaaagagaagacaaaatgaacctgattaaaacaactgaaaacgttataatcatttactccattttaattgtatttattttttgtttgtttttatgttatgcattcatatgtgtggatgggtgcatgtgtggatgtgtgcctgtgtgtacatgtgtgtgtgcatgtgtgtgtccagagatcaatttcatcacctccattttaaactttttttttaaaaaaaattgtattacagtctccatggttgacatggtttcgcaaatccttttttgttttttaatcatattgaaatttattccaaagagttttggaagttatgtggtaaaggaacgtttataagaaaggacttgctgatgatgctcttctgcagtgtagatgtaggtcagtaccacacagtgaccacatctgagacctcagaattttctagtcaaaatagactacagtaattgggatgggggaactcgaaaagtggaaactgtcatggcgcatatctgtttggaaggaggacctgttaacactgactattatggtcccttagctgctccaggagccaggcaaagatcaccgactttccaagacttctcctaaacctggaatggattgagcacaagcatgacacagtagaagaatgacatgaattttgtctgagtgctgttggctggaggctagaggtacatgtggttgttgagaccacagaacagtgtgacaaacagcaaatggatgctgtgtgtgatgaatacctgtgcatccttcagcagaagtaacgtcaccacagccctagcaatgtgtgtgtaagggatgagcagagtccacagtcctacggtcatttgaatacgtatatcttttccatgctcatgtacctgagtattgcactgtgggtatgtaggagctttcagaggtcaggagaggcatctgatcccctagaactgaaattacaggtggttgtgagtcaccgtgggagagctgagaaatgaactgggtcctctgcaagaccaataagtgctctcaaccactgagccatctctccagccccttaacctcattttcaaataaacttaagagttaagtactgaaaaccagcccggttcttttctcagtaatctttcattgttagcaattggtgcttcttctgagcttggatattcacaatgacactcctttaaaatgtttccttcaaaagaaaagaagggagaaagaaagaaagataggaagaaagaaagaaagaaggaaggaaggaaggaaggaaggaaggaaggaaggaaggaaggaatctttccttcaccctctaggtgtgtatcttggagacatggctcccttctgttaagtagtataatccatgtggctgtatccagaagaagtttatactttttggaaggaaaatggaaatacttgtccacttggttgtggatataaaaattagcatatttttgcatattaacagcaataggacatatttatttctagcatacctgttatataaagaatgtacttatttgctgtgatttaaaataacatttaagggcaggtgagagggcacagtgattaaaacattatcacaaaagcctagcaacttgagttcaatcctcagaggccaccaaaaggtagagagaacttgttgtacacagtgatcctctgaactctgtgtgcacacacactcacccacactcacccacacaatgagaataaaatttcaaaaatgaatgaagggattggagaggtggctcagtggttaagagctcatatcgctcttgaaaaggactcaagctgggttcctatcaacagcctacacagctgacagccacctaccactccagctccaatgcctctagcttctctcctctgacacctgcactcgtgtgcaacataaccacacaggcacatgttcatgagtgcgtgcacacgcaaacagttaaaagtaaaataaatctttaaaccaatcaaagaaatgataggaatggaaatttatcatttcaaaactattataaaaataattccagcagaattttcaataaaagataaaacccctggggtcaagttgtgtagaatattacctaatcttgcaagtattcctttgcaaattacaatgataaagaaaaaagtagcaacatgatggggagggggaggactgtcagacactagcccaactgaaatagagaggacaaaccaatgttgagtcccctgttgttaagctctgagagagggacctgtgtgatctgctcatccaaatgcacagataaacactagtcatcaaaaatagtgagacctgtggctggagagatgactcaatggttaacagtgcacactgctcttccagaggacccagttgtaaatgcaggcctacaactgcctgtaacccccagctccaggggatctcacacctctgacctctgtgggcacttgcattccattctcgtgcacatatccccaacacatttagttaaaataataataataataataatgacaataacaataacaatcgatgagaccagtaccaccagggacatgcttagctgctgatgtaactcggtgctagaggacctgtctaacatgcataaggcctgtgcttcatacttcagccctacacaccaaaagaaccattctgcaattgacctgtacaattcaaggttgttcaacctgtcaagaaaggttgcagttctgtacaacaagatattaaagaacatggaaaccaaatgcaatgcatagtcctgggtcaaaatctaaatatgaaagagaattttttctatacattacattaaaaggagacacaggggatttgtatatacattctacagaattgcatccgagttaaattccatgacttgataacacagccacaaaatcattgttgaagacacacacttcatgttacttagggtacagaatcaccatgtctaaatcaggtcttcaaaagtaaccaagtgctcagtacagacaggcatttgctgttaggcctgacttagtctgtaagatctagtcaatgtttttctcaaatgaaacatttgtacaatctccatacacagaatactcaagaagcctgttaacaagacatcatttgggggaaggtccctgaatgtttgctttttcctacttcctcctccatctctgccctctctgaacactttaacgagtgtttaatggtttgtgaagagacaataaagctctaggaaagaattcaatttaaaggaaatcattttaaaattgacaaatccatttatagttcaataaccatctcctaatttattgggttaataaattcaggatttggagtagttagatttttctggcatttttatcgtagtaaaacatatgtagcataaaatttgccattataaccaatttttgatggcattaaggacattcacattgactcagccatcaccatttttcatctctggaacactctggagcatttcatcaactgtactgagctctgtatcattaaacagaaactccctatctctcctcttatatgttttatagcctaaatatgcaccccttatcagatatgaaccttgcaaatatgtctccccattctatatgttgcctttttactttggtgcacaaaattttcaaattttggggcttggtttgcagctcagtggtagaccactttcctagaagtttttaattttcatgaagtgtgaagttcagtttgcccactttctgatgcttacatggctaattcccagagagcatttctgcttgttttctagagcagtgaatagcaatagtttttttttctctctttgcatttcggaacagtgatgataattgtcattcccctttttggaatgtgcaattgatacatgccgcactcagcaatagagactttggcatatatgaaataatccttaatattttgaagctaaaatactgctgactcctctgtttaaaatgagttcccgttaaatcttcatttgaatatgtctggaaatttctcagaagattacttcatatgctccagaacaaatgtgttgttctgctcttgtttttacacttcaggctcctttattttgcctgggctgccattgaccctggtaggttttccatgctggtatgcaaatgtcctccaattgcatatgctacaatgcctctgaagtgccctctccactctgatccaggcaccttgagctgcctggcacacagatctgtcacttccctgctgtggggtagtcatggaggttagcatagaacatggtgtgctgagttgcaggttagggacccaaagtactgctaaagaaaatattgacacatgctaagtgtaagaaagactttgttcagaaccactgtgaaaggtgtcaagattattacaagagggagaagactgggctctcctccaaacacaacaagggcaggattcataaccgaagcatggagtgcctatgtggacagagaggccagtggatggaaaattacatcaagggatcctagttaaactgactcaataagattcttgttgaaggtgggccatagtcatcaggtgccaaaaggacaggatgaagaatttagttagatagtcagattgtctctaaatggactcaactccattcctaaaacaatcagagtaggacagggaccaaggtcaaggcctgctgaggagagcttggcaaagcctgactaaggttctgtccaagagagaaccttgtctgtccgtccccttcttcaaagcaagaagacacaatgtagcccagggacaatttcccagtgacacataaaatttctctgtggtcactctactctgatattctgtttacaaaataaatctagtttaattagatttggcctgattattacattaataaaacaaaagcagtaaaggaccacactggctttttggtttgcttggctgggacttttcataagggttcggactatgttttttttaaagcctcttgagaggctcggtgtgtaaagttcctacttcacaaacgtgagaacctaaattgggatccccagcatccctgtataagctgagcaaggttacttgtgcccctaacctcgtttctgggaagccagacacaggatgatctctggagctggctggacagccagcagggccagatctgcaagttccaggttcagtcttaaaaataacatgggaccagagagatggctaagtgatgaaaattgtttgccaccaaccctgatgacctgagttcagtagaaggatagaactgattactgcaagtagtcctctggcctccacatgcaaaacacaaacaccacacacaaagccctatgacactaggaagccatggcaagaagccagaccagaaccagtcttaggacttgcactctcctttgctcttagctgcttttgcgctcttttcctagtgtgaagacacacgttctgctccccctgcatgcactttcaaactccctttcagatcccttttggtgctttggctgggaggtgctctagagagtcgaccctaacctacggtcacctcacccagttctgcagtaacagttacgaaaaccatgtgggcatgtctgatgttccaaccactttctgttacattctgtcacaaaggggacatgttcatcctgaacttgtgcaaataataagattaccatggaaataagaatattcaatcagaatttctgaatttggaaaggattaagcaaagaaaaaaatatgtttcgtttctgtttataaaggtaaaaccattgccattagttatgaatagattaagagaaaaaaaagttccttatatccccccaaaaacaaaaacaaaacaaaacaccaaagaactgggaaataccggaacaaaaagcaacaaccatccattttcagttgtacaggaaagttaaccctgcttactctacttgacctcaagttggcagcttcaggaatgcagcttctcactagagttggcagtcttggcagtgtagtagccctgccttacgcagtggccccgcctcacgcagtgaccccgccccacgcagtggccccgcctcatgcagtgtccctgcctcatgcagtagccccgcctcacgaagtggccccgcctcaggcagtagccccacctcatgcagtagctccgcctcacactcgccacaccttgctgtagaaatcctgaaccctgagcacctggcaggtacctttccttgagtctctgaaacattcctggtttttgaaagcaggagctcactctatagtgtaggctggcctggaactctgcatatagcccaagctggccccaaactcctcctctacctgcctcagccttctgagtactgacattacagccatacgccaccttaccagcttcccgaccgttattatttgtggagtattgcccagagctgattgcaggagataaccagagtaaaacagtaattatttatggaaggcaaaatttttagtacggccatgcttaaagatctaatgagagtatcttcaataaaaaatttagggggctggagagatggctcagtagtcaaaagcaccggctgctcttccagagaacccaggttcaattccaagtgcccacatggtgactcacaccatctataaatccagtttccaaggatttgatgaactcctctggcctcctgggcaccaagcaggcatgtgacactcaaacatacatacaggcaaaatattcttgtgtgtaaaatatacaaataaatatttttaaataagcaatttagttatttctgtgacacacattttatcttgttgctgtttgtttttgttttatttttgagacagggttccttgaagcccagagtagcctcaaactcactgtgaagcctgaagatgaccttgaacttctgatccttccacctccaccaaatgctgaagtttcaggtgtgtttcaccaagcctggtttgtgcagccagaagatctgttgattccaggtttttgtggcagctggcaagcattctaccaactgagctacgtcccaaccctttgtttactatggttttctagtctattttgaatcagagtcctgcctcaaatttttttcttttcttttttaaacgtttttgaagacaggatttctctgtgtagccctagttttcctagaatcactctgtagaccagattgccctcaaattcagagatcttcctgtctctgcctcctgagttctgggattaaaggtgtgcaccactgcatccacccagcattgaccattgacctcaaaattttcaagcctcactcccacttgttaatgtctaggactacaaataggcgtgtgtcactatgccaagctgtgcacacattttgacataacaactataaaactaaaattataactggtgatatgaaatggaatatataatgatcaacagaaacttaattatctatgaatgtcatatgatttctgtaatatttatatcaatggttactaaatataacattgggaagattgtatatcttttcttgcttgttacaattgaacatagcaaaagaatatagtctttataagaatctctttggaggctggagaaatggctcagcagtaaatgtgcttgctgtatatcaggagaaccagagctggataccagcacccactcctgtaaccccagctcccagacaggctggcgcttgctggtttctgatttagcagaaaaaatgcaagcactatagtcagagagagaccctgactcaaaggaacaatcagagaatgtcgaaaaaagacacttcacactctcttctggcctacacacacacacacacacacacacacacacacacacacacatataaataagccctaggaagtttttttttaaaaaaaaagaaagaaagaaagaaagaaagaaagaaagaaagaaagaaagaaaagaacagaacaataatacaaagtgcataggtcagtgttcattttcaactcaacacaatttagaatcacctggcaaggtagtttcaatgagaaaaatgtatgttagtttggcctacaggaatgtctctagggtattatcttgattacagtgaagtgggaaaacctgcccactgtaggtggcactagaccttaggccaagggttctgaattgtttaagagaggagaaggcaagctgggcttaagcatgtaggtcttcattgcactgtgctcttgactgtgtatacagtgtcaccagcatctccagtttctgctactgtggctccttgacgctgtaacctggaactgtgcactagaacaaccccttctcccttacattgcttttgtcggagcctttcagtcccagcaacaggaaaagaaccaagacataaggaaatatctttaaaaaagaaacccaagcagggcgttggtggcacacgcctttaatcccagcactcgggaggcagaggcaggcggatctctctctgtctctgtgagttggaggtcagcctggtctccagagaaaccctgtctcgaaaaaccaagagagagagagaaagagagagagagagagagacccaaattctacttgcacggctatgtgcttttgtgcctacctacaccattgtttgaagaagtttttccctttaaaaataaaaccttataaatcaatctatccaatctcagtcacctttgaccccacgagactcatgtcatccaaaactccacactggctgtacatccagaccttgtcctatacttcctctttcttattatgagataaccagtcatttcaatttaggacaaaatcactttcttttctcttcaacagaaacaaatcctacattctttgaatgattttcctgtgaagctatttctctttgcctttgtttttttctggtatttttagttacctgtgttgattataatttttcacagaaaaatgctgggaagtggcagctgggagtggtttgttacagatgagcccttcttcagtagacgggtggattataggcccctgtgccatctcatgatgtttacaggtacatgcttcttcacagtacagctttccagtttggcaaaagaatatgttaactaacagatccaactgaaagtattctctcagtaccttgtaaaaatgaagagccaagcatgatggttcatgcttataatcacagcattaaagaggcagaggcaggaggatcaggagttcaaagttactcttgggtacatagtaagtttaaggccagcctgggttacatgagactatctcaaaagactcaagacaaataaatatatcaacttattctcatgcttagtaatgagtgttttaaactggcatggtggcacaagcctgtaaccccagcacttgggtagcagaggcagaattatcaaaccttcaaggccaatctgatctgcatattaagttcaaagccaacctgtgatatataggaaggcttctgtttcaaaaataaataaataaatctgctttcaatcactgttttacttataaataacctgactgtttagtagacatctctaatttaccataatgtagcctaattctaaggatacatactaccagcaagatttttgaaaacttctgggaaacttgtcactgaacttgctatctattaattgtctttacctcacatacatatcaggcaaatatactcaaaataaaatcctaaacaggctgaacgcctgagagtgttatcttactgctgtggtagccatacatagagaaatataagaagcaattcatctcttctatatctttacccacgcacttctcccaaaattaattttatattttagatatttaaacacctgacaaaaattcctttactcccctagaaacctccatgcttgcattatgtttaatactgaagagtagaaggcatatccacttctattaaaccaataatgccaaactgagctcatcaaaaattttccttaaaacatgtggaaatgaaaaacattttgtttgtttctgtacttctgagatctatgatcattttcaatctttataaacatttatggctaagtatgtttaaatagaacatctaaatccttcgagatactttagaaattaatttgataatactatctagaggtataaaacctgcagagataacatatacacacacacacacgcatatacatacattcaaacagagacctcacatagctttgctctagaattcagccatgaaccagttaaatacaacaatacccaacttagtggtttataaaaaatagttggtgctcatctttgctccagtttatatttttatctgaattatgttttttggcaaatgggacatgttaaggttgagtacacagtagagggctcaagctttctgtaagtgtttgtagaaggagcttttggactctcctctcttgcagtcttacaaaggctgtggcaaaggctgagggggaatcaagtggttgtttgcatgtctccaatgctcatctgagatacacttttttttttcctctgcagcttcagatagtgatttacagaggtccatgagtcccttgagagtcctggtggggacagggcctaacgctgtagcctctgttgtgagctgacaatatggcatggaaaaggaaggcctgtggctgagtagagaagcaagcagtaggggcttgaaggggtgtatcacaggaaatcgaggaggcaagtgatggtgaaggaaggaggggtagaagcactgggaaagtagccagttggggaaagcttaatttccaggtcatgctagtaaaatcataccacaaggaaggcagcagagggctgcaggtgttgctcagaaggtagagctcttgcttggcatgtaagaagccctatgattcatcccctgtacaaactggtcatggtggcacatgcatataagcccagattcaggaggtaagggcagaaggatcaagagtttaaagttatcttctagtacataaaaactttggggccacccaggctatataagacacaaagaaagaaagagaaagagagacagaaggaaagagagagagagagagagagagagagagagagagagagagagagaaagaaagagaagagaaaggtaagaggggaagagaaaggggggaagggacttgttgaaagaaagaaaaaggaaggggtggagggagatggtgagggtgggagcagggggggtggagaatagggaggcaggtgggaggaaggaaggagggagggagggacaaatggacaggcacaaagtctgcacagcagtagtagaatagagaaagagcagaagtttaagaacagtctgtctgtgggatgccccctcccccattcatccccaattcacccctaaggggaagaaaacaagatcaaacagaacatagaggcctcccagcattcagggagtgggtcctggcttgaaacagagagcaggcaggacttctggcccaggagatacaacagcagaaagtacactcagcatcttaagattcaaagtctgttcccacaacacataccattgtgacatggtgatctgcctcaccaactcaggaggctgactcatcaaaggaattgggaagctggtcacgaatgcagacagactccaactcatcaaaggcacacacttgagtggtgtgtgtgtgtgtgtgtgtgtgtgtgtgtgtgtgtgtgtgtgtgtgtgtgcgtgcgcgcgcgcgcgcgcatgcattcagggcccagggatgagcctgagcttacccacatcactgaatcataactatggctgggggataattactctggtacttaacaaggatgagacttgactcagggtgactgcaggaggcatcaagagaacctcactgtggataaggtgcttgctcagtgtacttgaagccctgagttccacccccccaacactgtataaaccgaggcagttgcacacgcctgtaatatcactgctctggagtggggggggggagtcaatcctgaatacagcaggagtaatggggtccacagacaatggtcaagttaggggatgagtgaatgagagacaaaccatccaggtgcacactggagagctgttgagagtgcacatcttctcccaagatctggtgtcctggtcaccaaatgaaacagcctaatgcatatctcccaggaatgaagtcatttttatgcatggaataattgaaatacagatcactccgaaaagatattcccttcccctggagaggaatggtttgttcagctggctacattgcttgaactgagcaaacagatgtctcctttcggaagtatttggatccgtggcttgtggtttcccttgagggatgggggctaactggtcaaaaacacaccacagagaacagaaatgacaagttgacctaaggacaaatcctagtattgtgcctgtcccagaacacagatgcagtattggcgttttctaacttgactcgaagattcagccttgcccgtcgtttggactattgtactaattaatgctccttgattttcaccagtgagtgcttcacttttggcatattgttctgttttttaaacctggccttcaactgctttcttcccttcctcatttgtagaacagaacaaaccatggaagtaaaaacaggaagtttttaaaagaaaaccatttcctgatcactcctttctggctacacctgaaacaatcacaaaataccacgtcatttcctagtctctggttaagggtaacaaatggattgaaggttgatgttttcattctaaaatatataccgcattaagagaatggcatctgccctgacaacactgggagggagtgctcatgttgcaattgaattttccttttttcaagatatttcgctccttgctccaaattcatgttccaacatccctttcctttctgttaaccttttagcatcttatcaggaccaacagtcagttgatacaaacatctagcttgagggggagggtatgcctgagaatcaaattgtgactgatgtgtcattcagtttccaagactaaatgacacatcaggccttaccctcagaggagcaaataggcttcttctaaaaggtgaacaccaacatttgctctgtagaaaggtctgagaagtgttctaagggcatgtatgagtttagcaaaacagaaaacagctggattctctctgcctacctgaaaatgagtgaccacagaagcgctgcacactatctaacccctacttatgcccactgcaaggtggggggtagacacttacaggcactgtggcacagtcaaggaggaaccagtaaagaaacagaggttgagactagtgaaatggcataaggggtttagacctgaatgtgatccccgagacccacagggtgaagaggagaaccaacccctaaaggtggatctctgaattccagatgcatggcatagtgcatgtgcccatgtgtatatgtgtgcacacaaatacacccaaataagtaaaatatggaaaattaaaagaaaagttcggagctgggtgtgatagaccacatctgtaataccagcactcaggaggtagagacaggagggttatcagttccagcctgggctgcatagtgagaccctactagaaggaggagggggacacagaggacttggaagaacagaagcaggggagaagggggaggggaggaggaggagaagaaagaattggaggagaagaatgaggaggagtgcaggagaagaagaggaggaaaggaagaggagagagaggaggagaaagaagaagaggagaaaagagaaagtagaggaggaggtgaggaaaagagggaggaggaggaggaggagggagaggaggagattgcttgagttatactaagaaggcttgccagtacttctaaaattcaccatgcctgttctttgacttctaattatgtacctcaaagcctgtttttctgcttgggcaacttttgctgtatgtatctcacactggaatagatcacagatgtctattttgtgtttgtttgtttgtttgtttgtttgtttgagacagggtttctctgtgtcaactggctgtcctggaactccctttgtagtgcaagctggcctcaaactcacagagatctacctgcctctgcctccctagtgctgaattaaaggtgtgtgccaccttgctcacagaatgtcttataaaagatacaggacaattataccagttgttaaactttcaaatgaggcaggttgtgccatctttcagccaaatgcttttcagaattgcttatttttctagtactttgtgttagactagaaagaatggacagagatccagaggggagtagattgtcacatgtgttcaaagcttctagactgtcctgtgtctaccagccagtggcaagtgatgtggttgccatggaaggacaagactcaagcccaggataactgctgtgctcatgagaagtggagagttgatgaggttaaaactgggagcagcttaaagcttgtactttgttttgctctatttacctctgcttcagaagtgacagtgagccctgtgtatctaacaaacagttacagtggctggagaaacagctcagcactggctaagagcactgtctgctcttccagaggatgcaggctcagttcccagcacccacagggagtttcataactttctgtaagatccagttccagacgattgggcgccctcttggggcctctcttagcattgcgcaaacgctgtgcatagaggaacatacaagcaaaaacgtttacccacacacataaaattaaattaaatgattaaaaaaatcagtttgggactgtaattattaatcttgattggcaccttggtaggatttagaattagcagaaatacaaacttccatgaatgtgtgggggcatttctagattgtgagaagagccactttaagtgtgagcgtcacatgtgggctaaggccctggactgagtaaaaaggagacagggaactgagcacccacattcaccccttctgcttcctgactgtgggtgcagtatgattagctgcctcagccactccacctcaactacagctgctctttcagccataccttcccatctgtcatggactgttagactgtgagctgtattagtcagggttctctagaggaacaggaccaatgggagatataattatatatataattatatatgtgtgtgtgtgtgtgtgtgtgtgtgaatttatcaagtcagatgtaaattagaaacaatagcaaagccacacctgagggctgagaatctggtagtatgcttgacccttgagcctgggtgcctagcagtggtggtagccccacagtggttatctcccactgtgtggggtgagaacagcaaccagtctgcccacaagacagttgcttcagcagtcctagtcggcactgaaaccctggaagagcagctggtccctaatccacaacaagagcttggaaaacctggttctggtatgggtgaaggaatcgtccttggcaggaacatggcgtatcaactacaggcaagatgaaaggcctgtcgagaaacgatctttctgccacacccctttttacctgggccatctttttaccagaaggtgcagaccacaatcagggtgagtcttcccacatcaatcagcaatcaggacgcatctttcaggtaaggatctctgctcagctaatattaatttgtggcaaactggcattgaaaccaacctcagtgtgagccaaaatgaaataatccttcctgttttgtcagggattttgacagcacctaggaaaatggctagcatgaatctctcagatggcaaggcctatttgcttattattctaacctatcaggaggagatgtttcactgacatgacttctgcgggcatcttggagcatcctgtctcactcgggcctggtggttgctcaaatgggtagcactcctcagttgctcagccgtgggactcacagcttggattcttcagcagattcccattgagcacagagctttagaaggaatggacaaaggatcaatctgattctgtttaaagattcccagaattacaatcttggttagatttttctctaagctgcctttgaactgagttcagttccaagaattgcattttagagacctcaaggatgttggaatccctaaactcctggagattgaagcccagaagtcaatggaccacttaaggtatatcctgactcttgaattctaaagaagctcctcatacttcagcagctttctccaaaactcacaggaaagctcacccagaaagttccgaggcatttgatgttcagtagagtactgagagtgtgatatgcaattggggattatctctcagtggtggagtgctcatgtatcatggtcaaagttctgggtttgattcccagcaaataggctctatattgaagaacatttaaaaagtccttgtagacacattgagatggccctttgttttacattctttggaagactctaaaaggaaagctctcagtaacaatggcttccacaataggcagcaatacttgagaaatgccgtgttgcttaacactcaggcttttgaactacgtatcaaagtatttgtgtaaaatgcaatcatgactcattctctaaaagatgtctataaacattttcattttcttataattactagaagggaaaaagaacaagtagaagaaaggacattggcaccctaagtgcttgtatcccatccaaatcggcttcataaaggctcaatggaagaagcaggagtgtgattttaatgggctgggtgggttcttgcattcccagtgtacaaagcagtaggttgggaaagctcagtgctctgaacccaatgtactttacacatttattcagagaatagttgggttttaattatttatgataatagcactcagtgcactagtaaatgtccttcagtgcatattttgtaaagtaatgaagtctttgtaatgtgggctttctccgtaagctaccctctcctcactaacaaatccagggcagcggagtgtctgtgctcgcatagaagtgtatatataaattatcaaactgaggtttaccaaggtgccattgaatttgactggggatttctcattttctctatcacatcctcatcccccagccataacgtgaccaaagaaaatatcaccaccaccggggagatgagcaggctgtctggacacttgttttggtttctttgtaccgcctaattttcccctctgctgctatactcttacagtatttcaataaagcacagagcaagaccatcaatctcctatatttccctctagtctaagttagacatagtgcactgtatgactgtgtcttattatgtccaagggtcttcctctcctttttttcccttgtgtcttttgtttgttcctctttcctggtcccttggctgcaaggttagattaaactttccctcatttaagaaatttccatgcaccaagatgagagttcacaggactatgtcagccttgtgtgtgtcattcccttggctgataagtttagtttgaagggataaaaccactacaatttcaggttctgttttatactatttcagtaacccaggtcattctcatttaggtggtatccaacctaccttgataacgatagtgacaagtggtcacattataatgtacaaagcaaacccagatattatttgatgcaatatttgtggctgtgctgttcgcaggtcacctaaagggtcttactgtgttttggcttacaacaggaatgtctgtttcatagaggttttatgaaattatgggaaaatctctgtaaacaactttacaggaaaaaaatcaaccatgcttggtgaacagacctcagtattactcatgctggagacttgagcatttatgaagccactggatgtagcccttaagattttactattaacagctatttcacttaaactgcccaccattttgtgggttccaagagaaggactgattagttgaaagctacctataagtatctctttctcagatgatattgcaaattaattgtagtcattcagacaacagctggacctgcaacaatcaaaagtattcgcctataaatgaaacatggcttcagggagagtgaaacatactgaccaaagtttacttgaaactcttctgtctctagaataaagagcttctttgacttggatttaaagtaaatgaatcatcaatgcattgaaagaaacggggtaaaaataaatcagattatctgggtgctaaatctcagattatgtatgtgggcccggtgctggtagaagcagctctggggacagatgatgtcagactgctcagacactgtttttttgtttgtttgtttgtttttggatttttttttttggtttttcaagacagggtttctctgtgtagctttggagcctatcctggcactcactctggagaccaggctggcctcgaactcacagggattcacctgcctctgcctctgcctcccgagtgctggtattaaaggtgtgcgccaccaacgcccagctgctcagatactgttaaagccccagatggacagcagtttctaaaatgcatagcaaaacctacattcccatcagtgttagaattttggtttacagacaatgagaatgacaggaaaaagatatttatcagccagggttggtggcattcctagagaagctgaggaagaaggattagaacttcaagacctgcctataatacacagtcaattcaaacaacttaggttcagtttcaaaagagaaaggggaagaaggctgtggatgtgactcaatggtaaagtgttagttaacacctgtgttgaatccccattgctgctaagtgtcctgggatcaacacttctgtgcatgcaatggatgactataatcatttcttcattcatttgctccatatctcatgtttaaaaactaaaatttatgtttgaatttactagtttataataagagctctacctccacaaaagcaggcatacaatatcattcatcatcttcaaaacatgtaagggaaactggctaatttaaagctcagttaatagaaagaattaagaatttaccctagccttccacagaatccacacattaacattctggctagtgacaaagtaatacattttttaaaaatgggagccagttggtgatagtgcatgccttaaatgccagaagtctaggaggcagaggcaggcagatttctgtgagtttcgaggccaacttggtctacagagtgagttccaggacaggcttcaaagctacacagagaaaccctgtctcagaaaacaaaaatatatatattgttattttttaaaatgggactagagagagatggataaggaattaagagtatttgttgctcttacagagaaccaaggttcagttcccagcatcctcattgcagcttacaaccatttataactccagttccagaggatctcttgccccttttgcagcaggcatgtacatgatgcacaaatgtactgatatattatttatgatttaataaagattgcctgaagtatcagaatgcaaagccagccacactagttagctatagaagctaggcagtggtggcatacacctttaatcccaggatgtgggagacagagacagctagatctctgttagtttgaggccatgctgaactacaccaaaatgatccagtcagaaagaggaatacctcacacaaaggagatctcagcacttgggatcccatgcctttaatcccaggatttaagaggtataaaaagaagcaaaggatctcatgtgagatttattctccagccacactgaggacaggtcagcccctttcagcctgaggtagaggtaagagctagtggccagctgcttttcagatcttcagatcgaaccccaatatctatctctggttttttattattcctgttacaatatatctgtctctgggtttatattattcgtgctaaacacaaacataccttgtgggtaaaacatacatataaaataaatcttaaaaaaattaaactgctgtaaggatagaatcaacaaaaatctagactgggtgaaactcagtaggaaaaacaattcttaagtttaaaagtatcaggagctgtggagggggcgtggcttagtgggtgaagggctgactgtcccatttggggacctgagatagatacctagcacccatgtaaaagctgcttgtgacagcataggtcatctcggctctgggaagtcagaggcagatgatccctggggctcactggctaacaagtctagaggagtcattgagttacaggttcactgagaaacctagcttgcaaaaaacaaggaaaacaacagaagaggacacctgactttggcccctggcttccacatgggcctgctcatgtgtatacacatgtctttgcatgcacacagaagaatcagtgattgtaatgagaaggtagggcagggaggctgacaaaactcctgtcaatcaattgcaatggctgggtcttattcatagacagagaaactgtaaagaagcaaaaacagacaactgaagcgacatagacacacaaatttggaaatgtgaaggaataaaatattggccggtgagatgattcagtggatgaaggaacttgccaccctaagatacaagccaacagcccaagtgtgatccctggaattcatgtgaagatggaagaggagaactgagtccataaagttaccctcttacctccacacacacacacaccaagtcacatgcactccacatgtagacaatacccaaaagtaatggtaaaatgaaacaattaaaaaacattctaaagcaattaagtttcttcagtggggctctagcttggtggcagagcactaacccagaaaatgcaaggctctgaattcaatctccagcacagaaggaggaggagaccgatgttttaggtaagaagctatggttagtaggtcttttaagaagagacctaaacctaacactgaaccatggaccagtgaaattacacatggtctaagacttcttcaaataaacaagcgttatagacagggatataggtcaaaacacaaaacaaaacaaacagaaatcaaaaccggctctgtgttgatacctgatgaagctaggcaactgactcattgggaaattcacactgtatgacaattgtacatgtttaaaattcctatagtccttttaatacataaaaaccaccttgagaaaggaaatactatcagctccaaatcaaagggagagaggccacagaagacttgggagaaatagaacatcgcaggcatctatctatacaagacaagaaaggaggggaaaggatgactgggaatctttttgtgtggggaagcttcctgagtctgttcagtttgtgcagagtactcaaatgtagcctctgctgagagcctttgttgagtgaaggtgacctttcccacctccgagagcctgggcagctggtcttgcctgaggtgtgccttgcaaggatcctgagttatattgggagttgggacatcttttgaccacaggcagctttgacagctggataggttagcaatttagtttgctgctacagaacgaagcacagccaactgggccacatgaggaggtaacctgagcccttaactccaacctgggagctgagttgcaacttgcctgttgctgtgactatgtggggacagaggaatgctatatggcttacagggtagccttgggactccattccaggagggacaagtctttcacaaagtttcgaaatacaatttggcaaggacctatgagggtgacttgttacctagttgaatgaaaagtaaatgtaagaaaaggtagaaacagggtggagggacaaatgtcagccagaaggccctggcttgtcgggagttttcagatggtgtagaaagcttgaatagaaagagaagcttcctttcccttctcaattctgtgaattctgttttaagttgtttcatttgtcctctgatattgttccttgctctttgatttttttttgtatgtgtatgaatatgtgtgcatgtgtgggtgtgggggggtggggggtgggtgtgtgtgtagaacagaagacaacctccagtgtaattcctcagatgatggactggaactcaccaagtaggctagggtggggctgactacctggcaacccccagggtctgccagtgcttggctaacaagtgtatgctgccacatcctgcgtttcagtatatggggtctggggatcgaactcaggtacccatgcttacaagcactttgctgagccccagctgtctccccagatccctgccctttatttctcattttcaaagtgtaacctgctaactgccacccactaagcataacatttactcccacgcctctccctggagacgaagctctctcctttctcatctccacgcctgttcctcctacctctttgtcaaatcttgcttttaagaaaaaacagcctctcttctttttccctctgagttcccgtcccttcattttctccgaggcctggtggcttgttctcttcctggttgtgacccctctgatgcatgtgacctccatgagaagagagcaagaaactcttaaagtgaggttacaatacgtttccccctgtaaagagctaatgtgttaactgtgtccctgggtcagagtcttgtctccctttagctccatggagccattactgggcccaatgtctggatctttcatcaccctgctgggaaagcctgccggggtcctgcaggaccttttccttcccaatgtgcttgttgtcacctaagtaacatctggttcaagatgagaagaaagaaatcagagcaataaatagaatgggaaggggaaatggcctgtgtcatctgccaaaatatggcttaggtaaagcgtagttaacatttcttctgtggggaactgaggtccatcacaagtcctgggtgcagcatgctgctgccagtggaaagtcgggactttctaaagagagagggagggagggaaaggaggatgggaagaagggagagagaaggaaggaaaagggggagggcagcaagtataaatatttcagatagtagccttccagattatttaattgggtagaaatagctatttagttatttatctaaaataactatattaaaactattttaacctccctctatgttttgtaaacaagatagagagcaagttcatttcaagcccaattttccaagtgataaaacaaaagatcagaggggcagattttttttttttttctggtggccatgcagccaaaatcagtcgttcagagatctgactatgttttggttgaggttttgttggtttttctttgtttttttgtttgcctttttggaaaaaaaaatgtttacgtgtgtgtgtgtgtgtgtgtgtgtgtgtgtgtgtgtgtgtgtgtgtgtgttactatacatccatggaggccagagaacaacttgtgttagccctcaccttccaccatatgcacaggtcctggggattaaactcgggtcattagactcggcttgtcagacttgaccacaaaacatcaagccatctcactacctgtaggttgtcactttttatcctctggtatgtaatgtcataggattgctgttcatgaagttaactgctgttacatttgagtctttacaaaataatttttactttttttttttaaagcaagtatgttcccagcacttgggaggcagaggcaggtggatctctatgagttcaaggccagcctggtctacaagagctagttccagtatagcctccaaagccacagagaaagcctgtctcgaaacacaaaaaaaaagaagaaaaaaggaatataattgttacattatagttttcagagaaaatcaattcatgtgaaagttgtaagcattatagtttttatttttaaaggattttcatttccttatttgttttaacatgggacttcaaatagtacaggctgacctcaaatttgctatgtaactaagaatgaccttaaacttcttctgatccctctgcctccacttcttaagtggagattatgaaatacactactacaagtacccagaatttttgtttcattttatgtatttattcctttttcctgtttaatttgagggaggcaaggggtttggaaagtagaatatctccatgtaactccgactgatcgaaaactctacgcagtccaagttcaccctaaactcattgtcctcctgcctcagcctccagagggtatgaaccactatactaagctttttttctttttttatatagccatcaaatttgaaagtttcatccattttgactgacttgcatgtttctgatttttttttaatgtaactgtacatagtaagaagcctttcttcccctttctgttcccggtctaaacaattacttcttcatcctgcaaacaaaccatgtttcagagtttcctgtgttctttggggcataggttacatacacacaggaaaaggtatattcctgaggtccctgcatccctgcttacacaaatagcaaccaattttgtatactcttgagctgatatttttcaagaacaaataaaaatgagatcctcgaagaactctcctgctttggctagtcctctttcctagcgctcatcctctcacccctaataggcgtttactttgcacttctgtgtgctagcaacacattccattccctaattagtggcaaatcttatacatgctcatccactcagcactgactgtttcagtgtaagcttcccaaagctgagatacacacactgagcacccccgccttgcaggatctaacatagcaacatgaataattatgagtttaataaatgcttttttgtgactctgacttctgatttccttgccacccacttggtatttggaaaccagatctatccatttttacatttcaattatattgttgctcgttaataatcagacaaataacatggattggccagattctgagagaagaaccttgggtttatttttttattaannnnnnnnnnnnnnnnnnnnnnnnnnnnnnnnnnnnnnnnnnnnnnnnnnnnnnnnnnnnnnntgtcggtcctctctgttgtatctttgtgcttagtataaatccaatcatatatgcagctggatttcattaagaacttggtaagtgtatctggaattcatatgaagaagatacataaatgcctaacttgatttttaaaaataaaaacaaagggatattagtaggtgtatgaagacttaatataaggggctggacaggcagcttagtggttaaaggtgtttgctgctctctcagagggctttagtgtgattcctgacacctcaggccacttataaacactgtaactacagttttaggtcatccaacaccttcttgttctacagacacctgtactcactcaggcatagagccacacactgatacacacacacacacacacacacacacacacacaactcacacacacactcacacacatacacctagtagtaaaggcagaactggttgataaaaggaacaaatcaaaaaatgcagcaacctaaagtggtcagagttcctgtgttaatgttgaaccccaaggtgatgctgttggggtacagggacttttaaggtatttaggcaataagaggaagagccttcatgaatccacagctgttgtaaaaaagagaaccaggggcggggtgggaggtgggtaagcccttcctctttgggcacaagttctcgtggtgagaaaatgatcatgtgtgaggaaccagacacaatctgcagcatctgccctaggttttcacccctagaacgctaagaaatgaccttctgttacaatttgctatgcttcatagcagctgaaacgtggcacaccagtttatggtggtctgtgctgttaagtttgtggctccacaaaacaaagaagagaagaaaatgtagcaaatggttttggggaaatctgagggaaaatacatctaggtctctgcctaaacctacacacctgaatataaaaagtgcaattaataaaattttattaataaaatacaggaaattgtgtggcatgaagaaagaacatgatattaatttttaaatattaaaagatttcaaatatggggctggggaggtggtttagtttgtagagtccttatgaatcactcaggaagtcctgctttccatcccactgcctaataaaaccagcatggttggcttgtaatgccaacactcaggacgtggtagtgggtgtcacaaattcataggtcatcctcaaatacatagaaggttcaaggccagcctgggatacatgagaccctgtcccaagaaggaaggaaggatgaccttgaattcacagagatctgcctgcctctgcctcccaagtgccagaattaaagccatttgccaccaccagcctggcatcttggggctcttttattttcctgttagcttggcttatccaactttgatgtgatggtttttgttttatcttcttatgttttattttgttatgttttgtgctacctactagaagcctgtcccttgctaatgaaagacagaaaggaagtagatccagatgagagaggatgtggggaggaactgggacggacagagggatggggatatattcagattcagaatatattgtatagaaaagaatctgtgtttagtaagagggataaaagtaactatttttaaaacaagattctaaaacataaacattaaggcatttgattatctaagagttagaattaagaggaaaaaaaaaaaaacaatggagagtgaagaccatatcttcattgcactaatttataagcagatgactatctggaatacacaaagaactcttgcaaattgacaaaatggcagaaactttaaagaaaaatctggacatagactaaaataggcaacttatatggagacaaatcaagaacttaaagaggaaccctaaataaattaaaataaaaataaccaagtatcactttataccaagtagcctggaaaaaagtagtatctggttaatgccaagtgtttttggtgatgtgtgctggtggaaggcagactggtgtattctgggaaatcaatctgtctctatttagttaaattaagtataaagatattctgggatccagcagttctgttcctggatatgcatctcgaagaagttctaacacagtcactcagagatacacacagggtgtttacagaagggttatttgtagttgtggacagatggagaccaattgatagtgagaggtaatacacagcatcagaccacagtgggaagaaagggatcacatgcacagatgttaaatatgtacttaagtaaaacaagattggaaggcataatacacctacccattgtttcagttaagaaaatttgagccaaaaccaatatctattttttaagaatacaacagaggatggagagatggctcaattggtaaagtgcttgccttgaaagaatgaggacctgagttcaactcccaacatgcacatataaagatgggtaagcccagcatttggaaagcagaagcaagaggatccctggaagtcattggcgagccagtttagccaaattagtgagctccaggttcagtgagagaccttatctcaaaaactaatgtgggaaaaaaataataaagtggagagcgacagaggaaaaaacccagtgtcagccattggcctttgaatgcatgtgtatacacacacacacacacacacacacacacacacacacacacacacacacacacgcacgcacgcacgcacgcacgcacacgcagtttaagaagccaaattatattatgacggtattgcaatggctctggaggcagggagaagcgcatccaaatggagtattggaataagaaggaatacataaataaaagtggttgtttgcacagactcatggtgatgatgatgatgtaccctgagatgagaaacagcattacctcatctttctacaggtggaactacagaagtagttcatatctttgaatgagtctaaatgattggcaacttcgcacaagatttaacaaactagacccaggtacctaaaacataaaataaacaacattcttctcgggcttgatcgaatcattagagaatcatcatctaataatttttatttattctattttacagtttggtgatttgagacaggttttttctgtgtagccttgtctatcctgtagaccaggctggcctcaaaggtgtatgccaccgccactgggataactagtaatttttttttaaagggtcatgtttgggatgtggctcagttgaaaaagtactgcccaggcatgagccctgcactgaataaaaccaggcatgttattctatgcctcaaatcctgacatttaggaggtagagccaagaggatcaaaagttcaaggttattctcaactagttagtttgaggccagctgaggacacgtgagacagtattgtttaaaaagaatcaaaaagggtctcgaaaggcaaaaacaaaagcaaacaaaatcaagaaaactgatttaacgagcaggggaggtgggaagaggatatcatggggaaatgagagtggctgaagaaatcccataggcaaagttgaagtaatttaagcaacaaactgctaaagttgagttggcttatgattcaacatgcgattatccattgctgtgtcaaaataaatacattatggaataaattaataaacagacaattctgttatgttcttctacagaagaatacaaataatttatgccatgagaagcagcacaaacccccccccccccccccctccctgcctccccaaaatatcacaggcagcacagtcctttggggaagctgccagcctccagccggcactactgtgcattagaagctgaaccagttgcttggtggcttgggttaccatgactggctttgcaaagtagaaaactattatccctcccttggtcttggtttcccttctctatcataagaacctccaactaaaagctctctacttgatgagggtaaactcagggctctggagtgagcctgcttgggtttaaccccatcctgccttgacaaaggctttctttttaaaatctttcctgctctctctcttcttcctcccttcctccctccctctctccctttcttccttccttccttctttacttccttccgtccttccttccagtacccactatgtatctcagacctgcctctaacttgtggtaatcttcaatagcctgtgtacatactcagttactgttaaccattaacctttccaggaggctgggtttaattatattagctcagtgctaatgtgaggacctgggtttggttcccagtatggaaaaaaaaatcaagttaaacatccaaagaaagaatacagtatagaaggggaataaaaagtcacatgcagatatggtgataatttatgatttattaatgcttgcctaaggattcagaaagcaaagccagcctcaacctatagcgatcaggtgatggtggtacacacctttaatcctaggattcaggattcaaaggtagtcttgagtacaagaccaccgtgtgctaccagagagtgaatcagatcttacaactttaattccaagatttgagagatacaaaagatagaggcattcagtctgttagtcttagccatgatgaggagagcataccagtctgagtgaatctgagtgaagtcggagcagtttgaggatcacccctttggtctgagctaaggtagaggtaagagctagtgaccagctactttgcttttctgatcttcagcttgaagcttgaaccccaatatctgtctctcagtcatttattttttgtgctacagccaggcaaaaagcagcaccagcagttgtgataacaaggcctaacttaatgtacatggcactgttgacaactgctgtgacacatacctgtagtcccaggtgctcaggaggctgaggcaggagaattacctgagctcacgagtgaaatcctgtcagtgcaacagtgaaacttcacctctaaagaaacaaacaaataaatattggcacaaatgacctcaatgacccttgtcccagtacctcatatccttatctaatcatggagaaatatgagataagctaaacgtctaaccagtgtgcctctcaactactaccaacatctggctcattaagatggacggctcagtgggtagagggccccctgccactcagcaacctgagtccaattcctgggacctacatagtgggagagaactgactcctgaaagctgtcttctgactgccttgtgcacattgtggcctgcctaccctccaagtaaataagcaaatgtgaaaaaggaaaagaaaaaaaagtcaacatgatcaaaagtagaaaaacaatctgagggtctgtcatagccaagaagagctaaggagacctcaagtcaactcggcatcctggacctcagaaagaacgtttgtatataaaaaaaaaaggaaaaaataggaatatttaagtaaatatcaagtttaggtattaataatataccaatattggatcattagtgtgtcaataatgggtggaactagggtgcggctcaagagataggggagtcctggcctactgttcatcatgtctgttaatctaaagtttctttatgaacttggtaataatcatttcctttttaataataaattttattccttttcttaagatttatttttatttatggaggtgtgtactcatggaagccagaagaggagtctgatttccctagccggagttatgtgggcagttgtaagctgccccagtgggtgctgggaacagttgggtttgctaaagcagaaggcagctgtgctggtgctttgattaggtgatgcaatgacagtacataactcactgacctggaagagactctccaggtggcggtgtgccctggtgccagtagcagctcggtgttacaacagagggctgatttccttacagctctcagagtccagccacatgcaactagggagatattttaagcagtctgacataacaatgattctacattatgggggtctttgagcaaaagtgttgaaggacgattatctgtggggtcccatcttcttctggtcctagactgatacctgacacacagtaggtacttaacatatgttctagttgggtgtggtgctgtacacctgtgattctatcatttggatcatgatcaggagttcaaggctggcctcagcaatgcaaagaacttgaggccagcctgagctatgtgaaatcctgtctcaaaaaaacaaacaaacaacagcaacaacaacaacaacaacaacaacaactaatccagaagttcattaaagctgtggaaacatgcaccaaagttcagtgggcagccacagtgttttgtgtacatttctcacaaaacaagcagctgcataatacctggcaaaacaatcaactaaaaaaatttacactaaataccttctagttaatgacacttacctgtccttatggtttaagtttcaagtctccaagtaagagaactatgcctttaattctggggctgttgggccatgtgtcaaatgtaggtatcttnnnnnnnnnnnnnnnnnnnnnnnnnntggaaactggcctatcaggtttgtttaatgtttctctcatgaagaaccttgaagcaattgaatgtaacaatttttcctgtgcgttttttattagatacagaaccttgccaagtcactcaagctaatctgcaagtcctgtaattatcacaaaaaaaacctactctggcaaattaaacccacttcttagtgcaggcttaataggcaagagggctgttgggaaagctcaatggattataagcgctactttacaaaacacaccgcagcacacttagactttgagatgtggccttaaatagttaaacaagtccattgacatcaacctggtgcatttcctttgtttatttttccccaaagacttcattacctccaacgtacctaactgaataggagcaaagggcctggtggaattgtgcagttctgaccgagggaagctgagagcctggtgcaggaaggaaagtgggcatcactggaggtcggagctgttagaacaagctctgagggaaatttgtggaaagaataactcgtggttataatcaggggtcatgcagctcatctgctgatccaaggtaactaatgattggtataatctgaggctctgaaagacaagataaaataaggacaaagcagaatcaaaacagtcttaggcatttgatcagcaaagttaaagttgaaacaatagggagctcggtaaaagtttagctctaagataagtccttgccctactcagtgaagggagatcagggctgacacagaaaaactagcttcagaaaagatttctgtataatcagcttcattttcaactgaaccgatcaagatctctcagggagtccaggtggcacctaaactgccaccatcaagtctgacattagatctgtctgctcacaatccccctcaaccctgggctgaatactgaaggtttttgtcggtctgcagggcagagtcctaggccacacacagaccacaggtcaaggaacacgagaggaactactgaagtgactaggtgtagcctggagtatctggggagctcaggcttgaagggactgagataaggaaagagccgagtcattttaactaactctagagttgactggcttcacactggacctggtgattaacatgacagagatagctttctgcaattcagcttcttcaattagaaaaaatttgcagctttctctgaggactcatttcctatttgaatgcttcagatcagatctcagtaggctgatgttgggtctcatcttgcacacatcctggagaatagaagaggcctgggtactgggtgtgtcctactagacagggtactgggtggagggcatggtgcaggttttcccactgcatctgttaaagggaaactcagagtcataagataaaaactcagtacacaatggcaccctggccactccactgtcagcaagtacatgcagttttcattgtagacagcagaaaaatgaataaataaataagaaaaaaccctccccattttttgagaaagagagaaagacagcaagcaagcctaggctagagtttgccaaaaaatgtgttttatgttcaagtaactcttttttaaaaatgtttttaagtataatgcaaataaactaagaaaattctagctgggcaatcgtgactcatgcctttaatcccagtacttgggaggcagaggcaggcagatctctaagttttacccagcctggtctacacagtgaattccaggagagccagggctacacagaaaaaccctatctcaaacaaaacaaaacaaaacaaaaaaacccctcatgactcagtaggtagaggccttctaggtcaagcctggtgactaagtgtggtccttgggactaacacaatggaaggagagaaccaactccctcaagctgcccctcaacaataaataaataaataaataaataaataaataaataaatataatgaattttttttagaaacaaagagaattcaacattgagaatcttttcttgccttgacactttttcggatacgtaagataaatgtttaagtttggagtatacaccactctgctatgaacgatggcctagatgaggccacagacctcatccactcagcagttcactatgaagtcctgagtagggctgactctttcttcctttactcccctaacccagtccattagtcctctcttcagagtatttttccttcttttttttaatggttttttgagacagaatttctctgtagctttggagcctgtcctggaactcgctctgtagacaccaggcgggcctgaaactcacagaggtctgcctgcctctgcctcccaagtgctgggattaaaggtgtataccaccactgtctggctagagtattttaattcatgtactttcccatggtgctaatatagtctaaataacagttatggctgtaataactttttcctgtctttccttttttcaggtagcatctcacatatccatggatggcttccaactccatatgaagcggaggttgactttggacttttgttcctccagcctccacttccaaagtactaggaatacagacatagaccactacactcagttcatgtggtgctgggtctgacccatgatctcatgcatgccaggcacactctaccaactgagcgacatctcagcacctgtacagtaacttcttcactagaaattccccttgatccttctcacaccatcaaagagatactaaaacatccctgagttccaattgagtaaatctccaatggtctttttatgaggtcacacatggtccagcctatactgtcttccaacctcacttcctctcctgttccccaacactgaatacctgcacaaggactttggctgagtcaggttgttttcctcaagggctttgcccttgcttcttctggggtagcagtgaccttccaaggcttcatgatagtcatctccatggcagcgcttttccacactgtggatgtcaggcagcctttccttccttggctgttctcaatgactggtaatctctgtgtgctttgcttactgcatcagtgacataaattttctctttttattagcagagatgcttacagttggtcttttcctacctacagcaagcttttagggcaggaaccacattggtcttatggtatcactctatctgtagcacttacaaccatgcctagaacatggcagacagtcagtgagtgtttgataacgggacgaagagaagaaggaagtaggtgacctgggataggaatttgtttcttctaaaaagaaacagaatagtgaaagtctttacgttgcagccatttaaggcctctgtcactgactcttcatgtgaagaccacagacaggccccatgacagacagagtaccatggcctgtgagatggctcagtgggtaaaggttgatgacctgagtccaatccccaggatccacaaggtgggaggaaaaaactgaaccctgagggttgtcagaggacatgcacataaggaaataaaacgtttgcagaaaaagaaaaaccaaagtgtcaagaatgtttttaaaagaaaaaaagagcaacaacaataaaaaagactacagactagacattctgtcttcatttattttcctgttgctgtgataaaacagtctgacaaagcaacttaaagaagaaagggttaattgtgactcactgctcaagggtactgtccactgcccaaaatggggaatcagtggtcatatcatgcccatgctcagaagctagaaagcaatgacctcctagtactactcagctcctttatccatttaaacagtctgagaacccagctaaagaatggcaccaccctcagtgggactgagaatgtctgcccccataagttcatgtatttgaatgcttggtcatcatggagaggcactacttgtaagggattagaaattgttgcattgttaaagtggatgtagccttgttggaggaagtgtgtcactggggataggctttggggttttaaaagcccaagccaggcccagtgtctctctcttcttgctgcctgaagatctgtatgtggaactcagctacttctccagcaccttgtctgcctgagtgctgccatgctccccactatgatgaaaatggactaaaccatcagacagtggtggcgcacatctttaatcccagcacttgggaggcagaggcaggcagatctttgtgagtttgaggccaacctggtcaacagagctagttccaaagctaccataaaaaaagaagtaaaaagagaaaatggactaaacctctgaaactgaaagccagccccaattaaatgctttcttttataacagttgccaattggtcatggtatctcttcacagcaatagaacactgattaagacaccacctcaacgaaagcaaccaagataatcctgcactggcctgtctcccaggtaattctagatctgtaagttgacaacattaaccatcacacttgttaatttctagtcaagggcaaagctagaacctagttgtctttagtgtccaacttttgcattcatgcccaaattctagggtgtattaaatagactaaacatatcagttgtaactttttgcccatggctccttctcagagaaccagcccaccttcagctcctatattatctgattcctcagtacttcctacttctttccaactcatgactaaattgctctgagttgctctgccaggtgatctccacggaattaggaattatgacatgaaaaggaaccaattagatgataaaaccaaagtgtcaagaatgtttttaaaagaaaaaaagagcaacaacaataaaaaagactacagactagacattctgtcttcatttattttcctgttgctgtgataaaacagtctgacaaagcaacttaaagaagaaagggttaattgtgactcactgctcaagggtactgtccactgcccaaaatggggaatcagtggtcatatcatgcccatgctcagaagctagaaagcaatgacctcctagtactactcagctcctttatccatttaaacagtctgagaacccagctaaagaatggcaccaccctcagtgggactgagaatgtctgcccccataagttcatgtatttgaatgcttggtcatcatggagaggcactacttgtaagggattagaaattgttgcattgttaaagtggatgtagccttgttggaggaagtgtgtcactggggataggctttggggttttaaaagcccaagccaggcccagtgtctctctcttcttgctgcctgaagatctgtatgtggaactcagctacttctccagcaccttgtctgcctgagtgctgccatgctccccactatgatgaaaatggactaaaccatcagacagtggtggcgcacatctttaatcccagcacttgggaggcagaggcaggcagatctttgtgagtttgaggccaacctggtcaacagagctagttccaaagctaccataaaaaaagaagtaaaaagagaaaatggactaaacctctgaaactgaaagccagccccaattaaatgctttcttttataacagttgccaattggtcatggtatctcttcacagcaatagaacactgattaagacaccacctcaacgaaagcaaccaagataatcctgcactggcctgtctcccaggtaattctagatctgtaagttgacaacattaaccatcacacttgttaatttctagtcaagggcaaagctagaacctagttgtctttagtgtccaacttttgcattcatgcccaaattctagggtgtattaaatagactaaacatatcagttgtaactttttgcccatggctccttctcagagaaccagcccaccttcagctcctatattatctgattcctcagtacttcctacttctttccaactcatgactaaattgctctgagttgctctgccaggtgatctccacggaattaggaattatgacatgaaaaggaaccaattagatgatggtataaaatacatgagaaagaccgtagcaagccaacaccaaatgcaagcttaaactcccaggggattaaaatgctacaatgaaaagtaagtcagttactactcaaagaagctcaaggaaggagacacacaggtaaaatcactgacctgaaactacagggcccccaggatgtcgagatgtagccatgaattctgtatgtcacattctatgtctcatactaggtgtgctttgcttctgcccttggagatctatggtctattatatctctccttaacttttccagtgtgaggcttcccattcttgaccagggaagtgggtgttcaagttactggtagacctaacaaccaataaacatgtttgatgaggatctgctatattgaagacaccaaaaaatgatggggcaaacaaattcatgaaagaaatagtgatcactctgaggcaaagtaggtctcatagataaagaaacactaacagcaacaaaaatttattgatctgtaaggcagtgtctgataatgccataacaagatgctatatatttaagatttatttatttatttctattttgagacgggaactttcaaagccaaagcaagtctcaaactcactaggtagctacgaatgactttgaacttgtggccaacctacctctacctcttgagtcctgagattctaagcattactcactatgtatcacagtgcctggagtatacctgctggggttcaacccgaagccctgtgcatgccaggtatgcactccacaaagtgatctaaacccactgcccatatctaagaaattttaaaagttcattttaaattcatttgtataaaagaaaatgaaagcagatgccaaggaaataacgtgtactgtttcaaaaaaagagtttcagtggtgaattttgacaaataaaactgttttgatcagaattatactttgatctacatgtttgaagcacattttaatagaattcaaaactgctagccatgaggcaagtctcttctcatgaaaataaaacattctaatgttctttcacaaggagctgatggctatcctcagagtacccaagaagcatttgggcttaacaacaaaggtctaaatgaagttcctggtgtatccaaagtgacaccttggtatttcctcagtatgggcagaactagaaaaatgaaccatttgagctatctctgtgcaggcataacattggctcaaaagagccatctctagagactgcccaacatgaatgtatggtgagatgaatcttttccaactaagacttgttgaaataccatctataaggctgatcagatggctcaattggctgcaagacacgggaacctgagttcaaatctctagcattcacataaaactccaggtgtggggctggagagatggttcagccactaagagttcttgctgctcttccaaaggaccccacttcagttcccagcagtcatgtcaaatggcttcacaattgcccataattctgtctctgagggatttaaggtgctcttctggcacatgcacacacatggcttacactcatacaaatgcacgatacacacataagtgtaaaaagaacttttttttttttgaggcagtcatgatgacacatatctgcaatcccagttctggcatgatgagaattcactggtttaatgaggaaacttgcctcaaaaataaaaagcaaaattgtaagttaaacacggagagtgacttctagtctccacaggcatgcaaacacatgtacatgtgcacaccttcatatgaaataagaccaacagatccagtgaggtgattcaaagggctaaagcaattaccaggaaaatcaaatgacctgagttggatccccagacccatacaaagatgggagcagagaactaacttcacaacgttatcttctgacatccacatgaacgtacctcacagaataaataaatgcagtttttaacgtttttaaatgtgcattaatttaaaaaaaagaattttggggttgcacagatggctcgtcagttaagagcacttgctggtcttgcagggtttggtcccaagcatgtgtgctgggcagttacagctccagaggatcgccaggcatccatatgcacatgtacacagacactttttaaaaaggagttcgaacacaggtattatgctttggtgcattgtgcttcccccacgaaatacagattattaaatgaaagtctcagtgctacagtgggatatctccctatgaactactggtcagggtggctcccaaaacaatacaggttatagccattgctcttggttgctgaatttgttacttttctgtggctgtgatgaaacaccatgaccaaagcaacttggaagggtttatttgggctgaaggttccagagggataagaatccattaccattaccaaaggcgggcatttgtggcttacgactttaatcccagcacttgggaggcagaggcagggtatctctgtgagttccaggccagcctggtctccagagccagtgccaggataggctccaaagctacacagagatacattgtctcaaaaaaccaaaagaaaaaaagaaagagtccattaccatggcattgaagagccatgacagcaagcagtgtggctggaacagcaagctgagagttcacatcttgagacccaagaatgaagcatggaaagcaaattggaaatgccatgagtctttaacctctggaagcatgcctcaagttgctacttcctaaacatcccccaaacagcactactaactggggaccacatgttcaaatagatgaacctataagggacattcttattcaaaccaatacggttgcccaccagcactagatggtaaggccttgttgctaaagacaggcacatgttggttgcaaccatcctgacaagatgctccactggtataatagtagcatgaaagttatggagtttatcagctgctgtctgaatggattggaggtctgttgcactggagggaattcatacctgacactgtaaacatggccaaaatcctccccagtttgggaggtcataggagaggatgtgctgattggccagtctagcatgactgcttcagagcttccccagtctgtgtctgctaaatggtagtgagcttccaatttgattacaatgtctatctgctgctgtttattcttttacttttgcttgctatacttaataaggtcacccattcaaaactgaatatgtagctatcatagactgttctctagactgtacagaataatgtatgacaagagtctatctgcagggaaatccacaaggacagtcagtgggtaggtagctgtcaggggtaggagagtaggtttattttttccttttggttgtgatcctagcctttagtggtggaaggccatctctccagtccaataatttcttgtcttttttgagttaatacagtgatggtgagatgttggggtagtttgcatatggatagtcctattttctcacctctcgttgccttcttattctcagtatatattgctcttctttggatgtttcttttggcttatggtttaagaaagacacagtccatcatggtagggaaaataccatagcaggatcatgcagcctgtcacattgcatccacagcctgggagcagggagaggtaaatgccactcagctctttctattcatcctggaccctagctcaggggatggggccacccacattccaggtagcaattcccccctcagttgcacctctctgggaacactgtcacaaattctcccaggagtttgtagcctacgtgactctaaatcttgtcaattaattgtcactctatcaaaagacctcttagtacatacacagactggagactgtgtcaaacacattacaaggcacaaggtcatatctaaatgataaccatgaatcctcaaaatacagctaagcctttgttattacctattatctttatccaaaatgaaagaagggatgtgaaaacacatggcatctgctctgcatggtgttacatgcaatgacaggtgcatctctctatgttggaggtcagcctagtctacatagtgagttccatgacagccagagagctatgtagagacaccctgtctcaaaaacaaacacacaaaacacacaaaacaatatagtctacagtcgatgttggcttctgttagaaggcagcttgcagaattaatcctagagttgggaagaaagcaaaagggccttgcatccaggattacagctccaagtaaaggaagaggctaggattacagaaggtagaaggcagatttgaatcaccctctgctgaggtgataaagtggtaagcgggtaaataacatcctttctcaggggccatccaagcagaagcaaaggcctccaaacatggagcccacaccagaaacaaattatctaagaataattaattgattagtatctccaggaaacactttctcagcacactgaagatcccaacactgtagtcacatacaatgctggcctccaccaagacaaaggccaaaaaatgcctccctggtcctgaaagggctcattgtcctgtggggacactgaataagcaagtagtcactgtactttcagataacagctaggctgtgataagtggggctttggaagcacagacaaggccaaggtaaactccactgagggtcagaggctgcttcctgtgcctgcttgggttggattgtgaagaagagggatgaagtctctggcctggttgaagaccaatgatcacctgcaggaggacagaaccactcccaggaggacaggactacctccagaaagaaaggaccatgcccaagaaggaccacacccaggaagaaaggaccactccatgggagaacaggaccaaccccaggaaggtaggaacacccccaggaagaaaggaccatccgcaggagggcaggatcacccctaggaaggaaggaccactccaagggagtgcaggaccacccccaggaagggaggaccactttcctaaagtactcgaaaagcttaaacttttctttttctttccctctgcatcttaaagatgccttccatgctgggcttccttactctttgtctaatgttcctctcctcaccatgcagctgcccattacagtataactggcctgcttgccagcctcccttaatacatggcttcccttcccttcccacttctcttctccactctcttcctcccagaacatttgagatttacattttgcctgctctgggatttttctcttaaactctaataaaattatgctcaagcttccacttgagtccatcttagaattctttcattaatcagaatgaggtcctatcactcagcaaccaccaaggtgactccccaaagttcccagtaacaagacaagcagtagaaaacccttttaggaaactgccttaataacggggctcaggggtggtggtggtttaggctaggcattagttctcaaatattttggtttcaggaaatcttggacactttgaaaactgctaaaggcttcaagaaagccatctcacctaacatcatgcacaaacatgtgacaaaaggacattaaccattaattaattcttccattcaatggaggctggggctgtagctctgtttcgagaatacttgcctagaatgcatgagtcctaggtcctgttcccagtgcaactaaagctggtgtgatagtccatgcctgttatcttagcacttgagaaatgggggcaggggatcagaaatccaaggtcatcttggctacaaagccagttgtaggccagactgggatacacgagaccctgtgtcaggaaaaagcaaaagaaagggaagaagccaaatgatccttcctcagcaaccctcagctgcctccttcccagtgcttaagttatttgtggaagacggagagcatcctgtttggctcaggggagccaggcttgggccagggtccagcctccactacagcttagcaaggttgcttccagcaagtaagaaagtggggagggccatgccatggagcaaacagctgtcaatagcagctgtaggcttcaccagggtagaagctgccagttgacactgactgctgaccggtgtttcctggtgacacctgagcacaggatgctgaagcacactgacaggaggcagaggaagctctgagagccacagagcaggacagaagagtgcctaggacaagggcagggctctgtagtcacactactaagtgggacactcctattagcccccgagtcacaaggaagtcacttagatttttctagacctaaattttctcatttgcaaagtaaggggaaacaatcatatctgtttcattagtgttattctgggggcagatgagatatggtaaatattttagctagcatggacacttaataaattgaggctgttaaattattagttttagtatcagcaacaatctgcttcagggatgaaagataaccagatggaatagaaatgaagagagaagagaatgtttaaaaacagcactgacggtaaatatcagaaaagtcaaatatgttaagggccatcatgaaagatggtcatgacagaaccgtccctgtcatactttcagcctgttgtttcacagtggacaagaagtcagctaaatccacaagatcaaatttacacaaattccagccaaaccagttctgtgtctctgttaacctttgcagctgactgtgggattttcactttacccagcatgctgggtctgactgttggctttagtccagtgtactggcctgacaagatcgatcagaatctttgatcaattgttctttcattagatggcttttccattgttaatgccatctatgttttgatgaggatgtcatgtattttttccactcttataaattatagcagctatgagataggaacactcagaaggaaagtgagtttttcctaagccccattcagtctgtctctctgtaaaatgaaaataattatacatatttcacataaagtcatcttgagtaagtgaatcctagacacacctagtgctgtacctggtatttagagagttcttcacattctcccaggacctccctaccttccactctgtctcattttcttcttgccttttaaaactcttttaaaatattgctttaacacatcatctcgtttataaagagaatctacatatagaagagaatggaacactgatgtcccacactcctatctcctagaagtcaacatcaccacctcattgtaaacaaacaacaaacaacaaacaaacaaaactggtgcaaagcatcaagctggaaccaaagataagacatgagggaccaggggtggggagtgggtacagtgcctaacaagtaggtacagatccctgggtttgatcctcaacatcaataagccaggcatggtggcataccctggtaatcccagcattcatgaggtggaggcaggaagaccagaagagcaaggtcttcctcagctgtatagcaagtttaaggccaacctgggctacctgagaccctgtcagtcaaaacaaacaaacaaacaataacaaaatccctattcatttgtgaactaaaggctatatctctcctttttaagatctaatgagctctgctatttgggttcattcctctaaggctagactctccattctccagtaaattaatggtcttacacacgaacatcaggggaaagacagatagaaaaacctttctggattattctctcctgctgggcaacacacatcttgtctaaacacacatctgccagcaaacattgattaaggcctagctgtgtgtcaggcatggttataaatgctatagatgccatagtgagcaagctaacaaatcccatcctctcgctggagagaaacacccagggggaaaaatgaacaaagcaacaatagatgcaagtgtgacatggagaggctgaacaagtgacaagctactgtgactgtacagctcttttagaccaggtgggcaaaaaaaaaaaaaagcccctctgagcagatgacagctgagcctgaatcacaagaaagaaccagtcacactaagatctaaagaacattgcaaagagaagaaatatgagtgtgaagccctgatgtggggaatggagtcgctgcgttcagaggaccaggaggaggggttgtggtgtgaagttaaagcaggagagccaggggccatgacacatgccatggcctgtgagcatctcccagggagatgcagagagcggcagacctcctccagagagtccaactcacttgatcaaaaggtccctgaagagtctcctgtgcagccaagttgaggcttactgaggtctgggttttactcaccatagtaggcagcttggacttcttccagttagataggaagggaagccacgaactggtattaagcagaagagaaatgagatttgagtaatttacttaaaagatcccttcagttgccctgtgaagatcgaattgcagtaggagagatggaatgtagctcagtggtagtatacttgctagcaaacatgaggccctgggttcaaaacctagcacaatatgaaaagacaaagaaaggaaaagaaaagtagaggagagaagaagcaagctattttttgttgtatttttttaaaacttttaatatcattttgtgtgtttgtgcatgcttgcctatcaacacacacacacacacacacacacacacacacacacacacacagtatgagatcagaaaactacttgaaggagttgtttctctccttccatttcatgggatctgataactgaaggccatcaggcttgatacatattgcacatgacttcatttctctccaataaacacctaggaataagattttagtaacattccagtaacagaatgtgaatagctcactgtgcatggtggtgcatgcctgtgatctcagcacttgggagactgacacatgagggcaaccataaacatgaggccagcttggtctacacagttaagtgttaggccagccaaagccacatatgggaaccttgtctcaaaaagcaaaagtgaaatgaaacaccctccccccacaaaggggcaaataaacaagcatgtcatgttcatgcaataaaatattactccatagcaaaagccaagaatcaccgacatacaaaaacatggatggctcccaaaaccattatattgaggagaggggaagctgctgtcaggccttgggatttggtggctcacagctgccatttccagaattcgcagccagctacatgataacaacaacaaacaaacaaacacatgagagagggaggaagggaagaagggagggagggggaaaaggactgaaaaagaaaagtaaaagtacagttatcatagaagtggctgcctctagtggggaatgactgaaagggggtgtcttcgtttctttggttgtttctgtgataaaataatctcacaaaagcaacttaagggagaaaagttccaaaggaagacagttcctcatggtggagaagatgcgtgtggcaggcaggagccggaagctaaatggtcaccttgcagacagaatgataaacccagacccctactcagctctctttctccatttatataattcagggtaccctgccaaggaatgatgccacctcaatttctcaggagagaactaactcctaaaggtgttctctgatctctactcaagtgctttggcatgtggacatacacacagaaagtaaataaattaaaggtaataaaaactttttgaaaaagaatgtctcttaagtttttggcataggcagcctaatactagatgatgatgtcattgacagtattgtagattactggaaagatttggctggagttgaaggtgctccaaagctctttgttaccatgcagaaggctgtgacagtagctggacttatgaccatgttagcagcagattttttggcaaagatgtttcccactcaaatataaagtcttggagcaggagagatggctcagcagttaagagccattaagtattcttccagaggactaaggtttggtgcccatcacccacgcggaggctcacaaccatgtgtaactcaagttccagggaatcttatgctctcctctggcctctgcatacacctggcacacaagtgtgtagacagagtttggggggccaccagctcccaaaaaatgatatagaagcccggcattggtggcgcaagcctttaatcccagcactcgggaggtagaggcaggcggatctctgtgagttcgaggccagcctggtctccagagtgagtgccaggatagtctccaaagctacacagggaaaccctgccttgaaaaaccaaaaaaaaaatgatatggagacttattattaattatgaaacctgggcctacagcttaagcttgtcccactagctcttataacttaaactataatttatattatttatattaatctacatgttgccttgtggctttttacctctcttcaatcttccatctctcttttcctctctgtgtgctctgatatctctcttgcacctagattcattgcctctttctatctgtcttgaagtcccacctaacctcttcctttctagctgctggccattcagttctttattaaaccaatcagaaagcaccttggcaaaggcacacattcacagtgtacaaaaagattattccacaagtggtacatagacatacacgcagtcaaaacaccataatgtgtggtgatatgttatttatgatttattaaagtctgcctgacgattcagaaagcaaagtcagccaaacactataggagccaggtggtggtggcacacctttaatcccaccacttgggaggtagaggtagaccgatctctgttagttcaaaaccatactgaattacaagaaatatattcagtcctaaagagaaatagctcacacaagatgatctcatcacttgggatcacatgtctttaatcctaggacttatgagaggtatttaagatgctgggtggtggtggcacacaactttagtcccagcacttgggaggcagaggcaggcagatctgtgtgagttggaggccagcctggactacagagtgacgttccaggatagccaagaataaacagagaaaaaccctgtcttgaaaaccaaaacaaacaaaaatactgaatttagtataatgtgtgtctctgggaattatggacagttatgatagaaggaacgggaaaagaaggctcgtgagatggcactgggacctgatggtttgtgtttcatttccagagcccatctggtgggcagagagaattcacttctgaagattgttttctgaccttcacacatgtgctatgacacttgaacactcacaaagaaagagaaaaaagaaaggacacatttttagaaaattaaaatttttttaagagagcaatatgtagattcctgtgctaaagactgtactgaggcaagagattcatattagtatgagaccagctggggctatatagtgagttcaaagccaggaaggtccacatatgcagactctgacccaaaccgacccaaacaaaacaagaatgaaagacttcaggatgggatgaagtcatagtgcatgtgtggatgtgcccctgacccatgccacagtgcttgtgtggaggtcactgtgacccccacctccaccctatgccacattgcttgtgtggaggtcactgtagcccctctgccccaagacttgatgtgtgtttgaggtcagaaagaacttgtacttctctgttctactacatgggtcctagggatcaaactcaggtccactggcttgccagcaacagcttttgccctcagagcctctagccagccctatgtgaccgttcacaggttattcattgctatgtaataaatgaatcccaaaatgtacgcagggtttctacagataaggaccttgggagaactttatcgtttgggatctctgtgaggggaggagataaatttggttagttttgagtcagtgtctcttgtgagaccactgttgaaatgtgggccagggctgtgtttatctgaagacctgcctagagctggccaatctgctttctggattggtgagtcacacacaagccgctgctggctgtgagttggagtagtccagacccttagcagaccagggcactgggctgtgtttgcagccagcttccaccaaagtaagtgacctaagatgcaagatggaagccccagtgtcatttatgacctcaccttcatgggctctcccacaatagccaactggttatgtaggcccaccctgggagtgaggactggggggtgagaagtgctggggatctgtcttttcagaggctgctggtgattcctgaatgttttaagtttgccacacagtaagagtacaaggcagaagtggtatacacttgatgatcagacagacttaaatgttaaactatggcatacagcttagtcatgctcttcatgtttctgtggctgggctttgatgaccttcccctgctcagtgacatctttaggaaggaccccctggacacatcacttctcctgttctgccaacactgcttcctttgtttgcacttaatggacagtcttaaaacattacagcccaggcatcttcatctctgctgattgaggggggggggagaatcagggagacaaggacttggtgtataactcagttggtagagtacttgcctaggataaactgggtttggtgacacactcctgcaatccccacactcaggagatgacacaagagaattagaagttcaaaattatcctttgctacatattgagtccaaagccagcctagggtacacaagacactgttagagagagagagaggctggaggaggaaggaagaaaggcaggcagggagggagagagaaagagagaagagaccaagaacaagtgggccaggcatggtgttacatgcaggcaatctcagtacttgggatgctggggtaggaaggttgcaaatttgaagtctgcctcatcatatgaaatcctgtctcaaaacaggagactagagagggaggggaggggaagggaggagagnnnnnnnnnnaggggaggggagggaaggggcgggagggaagaaggaggtagaatgggactaagaaacccatattggtaatagtgtcatgagcaaaatatccccatatgtctgtggctccaggtttactgaacaattcaaccagtttggcaaataagatgaaaataacttgaaaaataaactttaaaaaagcagtaacttttttttaatactgggaaggtttgtgatgaatatataaatatttaagtaaatcacacacattgtattagtagtatttttgtgtaaagaaatctgtgtttagtgatttaagtatttgtaatatttcaaagaatgtggcctcttgaaatatgttagacatgcagcccttatttaaaaatgtataatctaagtaattgatttacatttgtgattttaagtggaagtatttcaaaatgtaaatgcaatattagacatgtataagaatgtaagattaacatatttataagattaatttattggctatatatgaatcagttaagtactccatgaagatttgttagtcacgcaagtgaagtactcaacaaaataaattgaatatattaaatttataaatacagttaaaatatttaaagtaggctaattaagggaatttgtaaatgtgaccacacagcaatcaaatgccctcttaaagtgattgtttaaatttagccatgtctataaaaatttatgtttaatttataaagtaacagaaaaattctctagggttttgattttgtaaagttaaagaacactttttaaaagtaagtaacaggctggagagctgctcagtgggtaagagcacctgttactcttgaagaaccttggaagttggttccgaaccccgcctaaggctgaaagccacatataactccatctccaggggctcccggagcctcttctggcttctgtgggtacccagtgcacatgtgacatccgtgaacacacgtccacgtgaataaaaacaatttttaaaaatatactgaatgttttagaaaaacactaactactggggaaaacaaagcaaaatgcagctgggttgtggtggcacaaggctttaataccagcactagggaggcagaggcagaggcagacgcaggaggatctctgcgaccctggggaacttttgaatagtgtttttaaagttgtttttttaattacatgtatttatatgggggggagggtgcataccactgtgttctagtggaggtgagaggacaacttttgggagctggttcttttcttccaccatgtgatcatcaggactgaactcgagtggccagccttcacagcaagcacatttacccactgagccttcttactcttatgaataatttttatgtgttatggtgatatgttatttatgattcattaaagcttgctagaggatttagaaagcaaagtcagccacaagacatagaagccaggcacacgcctttaatcctaggactcaagattaagaggtagagtgatctctctgagttcaagaccacccagggatacacaagattgaatcagtataaaagagtaacagatcacacgcctttaattccagcactagaggggtataaaagatagaagcagggtcttcagtattggacaggaggaactgattctctagccacgctgaagataggaacattcagtctccagccacgctgaggagaactcgtgagttagccctttcagcttttctgacctataacttgaagtttgaacccaatatctgtctccgggtcttttacttttcatgcaacaatgtacagaagtcactctggagagctgggatgtggcttgggtagtacagtgcttgcctggcatgactatagcccagcactgtagtccacaggcccactcaggaggtgaaagcagatcaaagtaacccttggccatttaccgagtatgtgggaccctgttaggaagggaggggcagaggaaagcgttttccactgatgttccagacttggactgagttagcttggcccaactctttctcctcaatgccaaggccaaaggaatggggaaggaaagcaggaagtcactcccttgcctggctgtctgtggtcccactccctcatcagtagggtgactcatataggtaataagtgagacccttgcctaattaccagcttacagcatggtgcttgctctccccaaaacagccacacacatgtcatgatggtctttcttttgttgtgatttgattgtccaggggagtcctaactgacctacaggactaattgtggctgcattcagcagagtacagaaaaagcctgaagagccctttgcatgaaaggtgccagttcattatactgcaggaatatggccaatcacttaagacaaaagtatacccagtcattggttgataaagggtgcagagttccatacttagtcctgtagtttgctatgaaccccctacccaactgggctgtgggaaggagcactcttgaattctctacaacctgttctttttttgtcttccatcaaagtctagctccaggtcgtgctgatttcttggtgcagatacagtgtctcagaagtctatgatgtctggagcaaaagtgactttgatttgaggtggtggatgtctgtatacacacctagcatctgcccattaccctgccccaatgcccttcgataacatagattttagaatccactataacttcccagtgagatgtctcctggggcctcctgtttcctcccctgcgctgtcagggcagctatctgtggtgcatagctgcagtccccaacctcagaggctcttggtgtggtctaaggcagtggatcttctagaactccacccaggaagcaggtcctaaatccagcaacttccaactgaccaatacttttggtttgtttcctagctgtttatggaatctttgtttctccttaactttcctttccaaaatctggagtgtctagtcagccatcagcctttgatctcttagcacttcctcagcaacttgggtaaaaatctcacccttgatctttatggatcctctgtagtggtccaggccctttattcctcacctacctctgtctcctcctcctccctgagatctcaaacagctgggattctgggagtgacatgcttcccctgggccctaagatctaagccccaggggtagtggctgaagaaggctgttctattttgtgtcatgccacaaggtatggtttgggtccatcctgtgtctgagcattggaggaagtacatacactggctccaagatgcaacaatagtgtttctatacatccactgaaactgacttcccatactgtgagctgtgatttttagggggtgaatgcttcctttcccttctcctttccagccagtggtttctgtgagattcatgggactacatgatcacacctgctgcccagtgaatgttagtagaacagtcatccaacaggctcatctctcttccttggtgccttttggtactgcaaatgagaaaaggcagtcaatttctttttggatatcaaaggtaaactccggatctatcaatgactttgatcttgagaaacagaggaagagagaggaggtaggagaggaaggagaagggggtaacaaagcagatataaaggggagagtgtcatagggctcagaggcatttctgtctctgggctcactaaaataaggtaaaagctttaccataatttctctttttccttaagctaaattgaaggtggtttgttgttgttgtttactttttaaaagtttctgactgatccagccctactggcacaaatttataatcccagctactcaggaggctcagacagaaggaactcaagtcctaggtcttcctaggctacagattgagctcaaggctggttctaaaaccttagtgagacatgtttcaaaaagaaagcgaataggaataaaggaaaaggggagccgggcggtggtggcaaacacctttaatcccagcacttgagaggcagaggcaggcagatctctgtgagttcccggccagcctggtctacagagcaagttctaagacagccagggctacagagaaattgttttgagaaatcaaaaaaaaaaaaaaaaatggagatgccgttcagccatgaaagcttgcctaataagcaggaaaccagggttcaagtcccaatgatggaggatagggtgcctcttgaccaactgtaatataaaatttaccatatacttgctgtcatcaaacaatataaatttagtcaagcgtttggcactggcctatagtcctggcactcagaaagtagaggcaggaggatcaggagttctgagatatctttgggcacacaataattcagaggtcagtctgttttacaggggacctgacttgaaaacagacaagagaaccaatataaattatttcagcctaaaatcaaggtgtcaacacaaccctactccccctggatgcaggaaggactctctagctttgggaagctgtgggctgtccttggcattccctgtagctgagttactccatttctgccttgtccctcttggtgtcttcttgtgactttccgtgttacaggcgtgcgcatgtggaggcacacacacacacacacacacacacacacacacacacacacacacactgattttttgtactgattccagtcactggttctggtctagcctctcagtgctggcattagaggtgtgtatcactgcacctggccactaccctgattttgctcctgtgtgcctttctcctgattctcagctaatagtttagggaggcaagaaaggtataaaagaagatcaaataaagcaaagatgatgatgtttatctttgaattttatttgtatatgctattccttgtcctttgttactactacagtgacctagagtgtcactaagctattatgaattctctagttttatctgaacacctaaatgaaatttctcattttgtcaaggaaaatacaaagtaccctcttttacctagggaagcttcttggctctgtgctcccctagacatagacattcaaaaagccatcaaccgttctcttgatgcaaaaggaaattcagatcttgatgcaatagatatttgacactatgctatgtgactggataaataggtaccgtttctattttcctttcctttaagctttagccattacagtcgcaatgcctgggttgaagaatccccacttgagcaaggcctttacaaaacacttttagtattcttggccctggatggcaactaagtctcttaaaactaaatgggccttgtttgctttagtggaatctgcccaccttagagatctagaggttaactagccagttcgcagcccccacccccagcccccggagggctttgctttgttggtttcctgccagcttgtactttcaagttgaaaatagttctttttgtctgtttttctagaacatagaattcattacctctggatccttgccaacagtgtccctctcatgtttttaaaactaagatgaatgtttcagcatggcttggtaggctcgacccacaatgggaagtcaggcagtaatactactgaatatctacaccagtgctttgctctgcctagggaggccggcaggcaaatgggattctaggaacacaggagagcatccagggtggaatctccagggctggactggagaaatcccattaggtaaaatttatctgggtttcctgttgccctcagaaggtctttggtggtctctgccacagaaagagcactgtccctctcccccgttagttgtctgtgtggagacagaatatttgtaaagggctctgtgtttcccctctttttaagctcttttctctctacccgtgccactctgtctgcctcctttctgttagcactgaactttctgctctcctcccacaggtctcagcagcatgcttcaacacagcccatggtcagatgaatccttcacatgccccctctgttgagtatgtgtgtatgtgtatttaattacaattctaattttgatggaactgtagatgcataagcagtttgaacggtgagatcttggtcatgacacggtctctcatgttgctctttcatagtcacacaaccttctctccagcctagactctcttgttatctcctggcagccactgatcagttttccctatctgtcattttgtcatttcaacagtgctgcataaatgcagtcatgtggtatgaaaccttttggtaccctttaccctaggcacacatccctggagactcatacatacgcaggaccagcttgtttctgcttactgccgagtgatatctgtgctgtggtgtagtatagtttgttttactattcattcattgaaggacatctgggttgcctcaagttgggtctattacaaataaagctgctacaaacattcactattggcttttataggaatgttagttttaatgtcttttgggtaaatgtggaagtgttattagtgggccatatggtacttgtatgtttgtgtttatttatatactgccagtgtttgtttgtttgtggttctgcaggttgaagcctaggttgagcatgctagacaggaagtaaacaattcaaaatgcctttaggaagtccttgaaattcactaaactataatgctaggccctgtttgcttggctttaatgtattttaattaaaaaattattactttccatttatttaccatgggagtggagaatgtatgtgtgatagcacataggtagaggtcagaagacagcttgaagagaagggttcttgccttccaccatgtaggtctcggggattgaactctgatcaccgggcttgatgacaagtgtttttttccctgtatgtcatcttgctggcctgttttagctttgtatgaaaactgccaaaacattttcagaagaccttttattttattttttttaattctcaccacaattaagagggaaaggtttagtgaatttcaaggacttcttgaaggaattttgagttgtttactccctgcgggatggactgcttccatcttggcaggaactgctacataacatggcaatctacaaaagaaggcctctctacaaaccaactctgaccctgattgtagacttacaatctccagtttgagaaggcaaaaatttgccttgccagcctttgatgttgtcacattttcatcttagccattctgtggtaacatcttgtgatttggtctgcattgtttccttgatggctgaagatgctgaccatccttcattgtgcttgcttgcctgataaacactctctgtgtgatgtgcctgttcttagttttctaactaaattgttttaatttcaagttttagtattatatatatatacatatatatatatatatatagagagagagagagagagatatagtccaggctggcctcactgtgtagataaggatggccttgaacttctgaccctcctgccgctacctccaagcgctgaggttacaggcacacatcctcacactcattagtgctgggatgaaagtaaacatgctcagcaagcaatctattaactgatccatcatcagcctcgtgttctctacaccttctacccaggagtcctttgttggggtctcagttcaaaaatatttctaccattctgtagttcatgtttttactctccttttttatgttttaattttgaaggatccaatacattaatattttaatgcctggtagtggtggcacacacctttaatcccagcacatgggaggcagagatagagtcagagccaggcagatctctgagttcaagggtagcctggtatacagaacgagttccaggacagccaggattacaactgtgaattctgtctcaaacaaaacaaaacaaaacaaaacatgtttttccctttaaggattgtgctttcagtgtggaccttaggaatgtttttatataagttcacttccacatgtatttaattagccattaagccccactttacatctctgctgtctaaaataagttgcggagtccttcctgtccttacattctttcccagagagccctgagctgctgtgactcaagtcactgatctcaagttgtgcacacagttcctgatcatgtgattctgactatgcagcgagtcagtcctgtgatgtcctcaagaacatggcctctggagccagactgtcctggatcaagcctgatgccacctcaaaatagctttgtgatctttagcatgtcactaggacctctgaaccttgaattttcacatcacacacatctttatgaaaataacaataccgaaggtttgtcctgagaggtgagtggaacactgtgtaaaatgctttgcacactgtcaagcaaatacatagaaaataataataaccgttaatgcttcccccttgtgcccatgtaaagatccctaggtactactctctttccccagggtcctttctctttattttctcaatgacttttaagatttattttttattattttttgatgagtgctttgcatgcatgactgtgcactatattacatgagagcctgatgtccatgtgggtgctgggagtagaacccaggtcctctgcaacaagtgctctcaagcactaaaccaactctctagcctccttctctcagtacaaattaatctagtttgtctctgaagccttcccggtcaacctcagcatttgatagaatttctttatttccttttctttttttttcctttttttcttttttctttttgagacaaagtttctctgtgtagctttggagcctctcctggcacttgttctgtagagcatgctggccttgaactcacagagatctgcctccctctacctcccaagtgctgggattaaaggtgtgtgccaccactgcctagcttgatagaatttgtttcacattcatgttacagctttcatcacttgcatctgttataatctctatgtaacctcatgtctccagtgagcatgctgtggccagccctattcagtgtgcagctctatgctatgaaaagcaacctgtttctaacatactgataaccaggggtccaatggaacaattaaacattttattacattgttatacatttgtgtagttggttatttattttgtgtttgaaggtgtgtatctgctccatggtatgtgtgtggaggtcagaagagagctgtaggttctctccttccactatttgggtcttggcgattgaacttgggtcaccaggtctggctagcagacacagttacttgcagatgaagctcatcccttcatcatgttttgtggaaatcaatatggcaaaataaatcttgcaatgtttgcctagcatttgggaagttcttcctgggattagaacctagaagcatcaaaaaaaaaaaaaacaaaaaacaaacaaacaaacaaaaaaattcatcactccctttgatccagtgtttcactttttttctaagaaatttaaaactggtcagatatttaaatggaaaaatatgtgtgatagaaatacttcttatttgtaaaaataagcacttagaaaactacaaatgccaatgataaaaatatcaggaatcaagacaaattccacaaatatggtggaatattatactgtcaatacaattttaaacaaaattgtttcatggattgattatatggctgtaaaggcatttctctataaacacaaaattaaccttgaagcccaaccagtggataaattaagttgttaaaacacagaatgacaatatgacttcatttgtttaaacaaatgtctgtacatgtagctctgaacacaaacacacaggacaagaatggtaatagtcttctggcactagccttttggtcattttcatttcagctacagcttctctaggacatagcatttattattttgacatgaaatagcaagaatgagggctggccagatgactcagctggtaaaggtgcatgccgccaagtctaactgggttcaattcctggaactcatgtggtagaaggagaatccactcccacaagctgtcccctgaccttcacactatgcttcagcacattcactgccccctcccagacacagacaaaataaaaataaatgtaaaaaaatttttaaggaaaataaaaatgaaagctatagtcccctgtgagtttgtattgttagcttttttcagttatagtttaaaacagggtcttacatgtttgccaggctggcctcaagaccaatccaatcctcctgtttcagcctcccaagtgggttacaggcatgcaccaggacaggcaaccatactctttttcttattataattatctgacttcttcatgggtcacttttcttatttgcatcaaaatgacaagtaaaaagcgaggctgtagagacctggttttttagtgtgattttttagtgttttattttcatcaggtctgagactttaaaaatatatctttgtaaaagtacatacctgtcatgccaggttaacacatgtcttaagacattttgttcatgtatataacaaactttgatcatattcacccattatcatcttttcccatctcttaccttcccaaatcatttaccttctactctcctgtctttttttaatctatatttttgcataatagaagagaacatgaagtatttgactttgtgggtctggcttattttgcttaaaactaaagccagacagaaggatggggagtctatggacacatgggaaggtaaaggagtttctcacccccaaatctagttgaagtctctagccagctgagactaagtattcagggccctttaccccgaaaacctgtaattttctaggcatctcaacagatgtcaaagggcttagccttgcttgcttgtgcaactctggtggctccttcctggttttacgttcacagattgaaattctacccaaggcatcctaggagccactcagtaaacccagccatccatggagacagagagactgccctttagggacccaatgaacaatcacacctcagagtcaaaggcttccaaaaccctgcagaaggtcatcttgatgacacaagtgtgactctcctttgggaagctcacacatttcttcccaagtgcctctctattaacctctgtgctgagatctgtgttaaaaatgtcttcaaaccaatctccaactgcttcatgatggtgcctcctggaattcttttctctagcaaaaacaggaatccacctttactctagtggagaaacccctcaggctgctggtggtagttagtatctgtgtctcctgctgtacagccctggacaacacgaggtctctacttctgttcattttctcacaaacaacatgcttttattcttcatgtttgaataacactcaacacacacacacacacacacacacacacacacacacacacacacacacacacacgcacgcacgcacgcacgcgaaaacaacaataacaaaaaccataaaaataatcaggaaaacaatgccaattgttttcaatgtaatcaccatttacgataaggacaaaactgcatgaattttgccctagaaaaaatcatactgacctctgagtggaagaatgaatcagggtagccagggaactaaggccactgagatgatgatagccatagggacagagggaggagacctggcttgaatttgacttaatggtaggttaggctgtggtatgaggaagaggtgttggaagaacaggcatcagtgttgacatgcttatcagtggcagggatggaggattttttttttttttgtaaatatataagatgtatttttttgtgtgtgtgagtgttcgcctgcatgtattcgtgtgtaccataagcataatgcccatggagggtagaagaatacattggatccctagaacagggattatttatggacgattgtgagccaccatctgtgtgctaggaacagaacctaggtcctctgcaagagcagtaagtgttcttaatcactgagtcatctctccaggtcaagaattggggttgtgttttgtcttatttatttgcttatttatttatttatttatttatttatttatttattagttcttttgagacagggtctcactatgtagtcctggccagcctggaactcactatgtagatgcagctggcctcaaagttagagacttacttacctctgctcctaaatgctgggactaaaggcatgtgcctccagggctggccgggatggagttctttttgagagatttccacataagaaaaacttgatcctcagtgaaactgttgatagaatttgaggacaaaacaacataaagcagagttggaatttattaaaaatagagagtaaggaacaccaagagctgagtgtgattacgtgttccagtggtgattacatataggtttgggatatttgaatttcattgttcagtaggtttcttaggcccctctcttcatctgtctctacttcttttattgataactgagattatagagtggttctagaggagactggggtaggattacagtaagacaggataaaaccagaagccatcagggttgtacaaggggatgaggacctgtagtttgtaccgtaggaggagtttctggtgaaagtcctgggaactgtgcagaaaggccttaaataaaagctactaattatgttggaactctcagctggtgatagtgatgcagggaaatccaggtcttgtggttcctagtctccaagataaaataatttaagaatggactcaaatgcaagctcaaggataattttattggagtttaaaagaaaaaccccaggacggacaagctgtgaacctcagcagctgcctggagaaggatggcgaggatggaggagacaaggaaaaacttatcttattgaagcaggcatggaggccagacacagggtctgatgagccgcctcatggtggcaagcaaggcacgtttttgacaaagtcaggaagtccaaatgttggggaacagggggagcccagagggttagagaaagcatgctaagagatagaaagaagtaatgttaatgtttttgaataattcagagaagtaaccggacatgatccttaagtgaccatggtccacaggcttctgcactaagggatgggatgctgggaaggaaagtgcagtatctcattaaagggttatcattcaacttatctctctagcacggcttagctaccttgtagaggtggtcctcagatcaaactgacaagcccaactgcaatgtcaggtctctatcctggtctgacattctgttcccaggaccaggaggttttctgctctaacaagagccttcaactagataccaagataaagagttctttccctccccagttccccagatccccatgtcctcaaaacttcaaaggcgcatcactaactgaggcagagatgaagagtcatgaagtgggaggaagataaattctgtttagggtaggctagtggtatttaagaagctgctgaaggtccagtggtgatggcacaggcctttgatcccagcacttaggagacagaggcgggcagatctctgagtctgaggccagcctggtctacagatcaagttccaggacaggttccaaagctacatagagaaatcttgtcttgaaacaaacagacaaacaagcaaacaaaaaactgctgaagatctgaaatgagtccagtatcctaccctttaatctgggcacttgggaggcagggacaggcagatctctgtgagttcaagccaggttggtctacacaaagaattctaggacagccagtgagactgttttgtcaaaaaacaaaacaaaacatccccccccccccccccccgatccctcagtgtcacagccccaaccaaggaggggtaggatatgaattgaaggttaaatatgaaactgatgtttggaggatccttggagatctcatcaagaataggaagtgacttaggacagaatcctaaaggaaattcacatttaagagggtgagtaagaaaatgggttcagactcggtctggaacagaagagtttttttgtgtgtgtgatgtaatttacaactccgtcaggaaagcaattagcattcttgataaagtgtgtcaacagttttctaacagactttaataagacagagaactccttctgggaagctagggttacctgcccagctgattgactagtctaataatctttaaccagatgttttctttccttatctctcttgtacccattataatcatcaggccaacttttttttttcttataaaatatctcaactaaaattaccccgtctttgagatttttcaaaatgcctcttctcatgggtgaggcttgaccagggaatcaacagaggtagatgaggaaacagaggaatgttagagctctgtggaagccagatgacatttcaagagacagggaaggaaccaatgaggtggctcagcagataaaggcactttctgccatgtcgggatccacgtggtgaaggagagaaccaatttctgcatattgtcctctcttctctgcatgcctgccatgacacacacacactgtctctccgtaaatgaataattaaataataagaaattaatttgtaagaactatctacatattacagacaacaaaattaaataagaacaaagaggaaatggcgtgaatgaacaacagtgtaaaatttggtgaggtccaacaacctaagcgtaagagactggcctgggatttacctagaatgtcagcgttagctctgtgtgtctctttttgtgtctttctctctgtggcagacccaatgttttttgttctgttttttttttttttctttttggtttttcaagacagggtttctctgtaactttggaggctgtcttgggaactcgttcagtagaccagtctgtctctgaacacacagagatttgcttgcctctgcctcccaagtgttgggactaagggtgtgtactatcaccgcccgggcgatccactgttctttcaaaaggagtgggtgtaaggagcagtgggggatactgttctgccccacactgtattcaaatgtacccgcaaggagtttgtagccagagaagtatgaggtagagttggaggctcagagggcgggctgggaggggcttcggagcatgtgggtaggcgggtgggtgctgtggtgtgtggaaaggtcaactcctcccactgtgactggaaagaccagagaaaagagcctgctgggaagatcacttgcacgtgggtactagacggcaggagaccttcttgtccagtgtcccaggtagccggtggttccgctcaactgctcaaagtactgaggtaggtggcacacctttgaggtgggtcctggggagaagaggacattggtgagggaaatgcgaatggcttccgggattgctgaggtaggagatagcgactatattctggaaccagtgatcgactatattctggaaccaatgatcgtagcagtctgggattttcttccctttctccgctctccgctttgctcccaccaagcttttgtgacaccctctctggtggaaaaggcattggagctgagatgaaatggaacttgtggcgctcctgcctcttgcgccggagcaccgggatcatttcgtgctgtgcaatggatggaacacaggggtttatgtatgttaggccccacgattctctccagagccgcttccagttcaaattccgccatagggaactctaatatctgaattccaggaaaaccgcgtaactttgcggcttacttactctgctgtgtccaacctaggccttgtgttcttacttctttcaaatgatctatctcatccacatcctgttaatttgtgtgttataactctgaacccgccgccccctctggtaccactctccttatcctatctgttttctgggtatcttggatgtctaaattggtgtcataggggaagctcagattgatccttctgcggaagaacgggaacgtgcaagggtctggtttatcctgtaggcccacaggaaggaatttactaggccccggaagaccagggcgccttcaccaacttccttttttgggggatgggttggggacaggatttctctgtagctttggcggctattctggaatttgctcgaactcagagatctgcctgtctctgcctcccgagtgctgggattaaaggcttgcactttcccctagtgctaatactcaactgttgcccaatctagatgcctcaggaaaactccctccctcactcccccacacccggcccagaaaagtctgtcacagtaagacttcatctcctttgtttcatgaacattcaaggaagctagtgggagattgctatccttacagcttttcttcatctcccagctcccacccagctagctcttcctcagaaaaagggaaacccgccttggtttttcatttgctaataaagtgggcgcagaccattaaggtgtattgtggaagaaaagaagaaaatggagctttctggtgaaggcataaagagatcctggggtggctactcaaaaggaccctaggagtctgtgggaggaggggctcttacctgggacgcctcggcctaggccttgcactagctggttcccggtttcacaatctcttctctgcttttcctggcaagcacccctgcagtgacccaggatccctcagtgtcacagccccaaccaaggaggggtaggaactgttagttgcccttggcaacgccttttctctaggctggtttgcctgctgtctcccaacggtgacccacttctacatcagacccccttcctctcttacctgcaggggcctcttgattccattcccgacttcacactgctttgtcagcctttccattctccatactcaagtcccatggttcatgaaagatatcaacgttcgtctgtgtgttgtggcataatcctataattccagtttctgtagaggctgaggtggaattgtaaattcaagacctgaaccatagagtgaaccctagaccagcctaggcaacttaatgagaccctgtttcaaaatcaaaagtaaaaatagtgcttgaggtgtagtccagaggcagagtgcttctcttacacaggcaagactctgggttctactcccagtttggttggggtttgggaatgattattagatctccatcttcctcaaggaatgaaaaatagatcagatagttgagaaaacacttggttagagtgtgaggggagaaggcaggaattacacaagtgcttctctctgtgtaacccagtcatgatcccctgcctcagcctcacaagggcaagaataactggtatgcaccaccaccatttctgggttttgtgaaacgatttctggaatgccagtgggttagtattactgcaagctccatgtagatggctggattctactttccaaatcctcaggtctgagtggggccaacaggaatgggtttccaacaagtcctcggtgctattgatgctagagttggctagagattgccttctcaatgacgacccttctagtacaaagagaagggtagatggggttagagtcttttctcagataaaaggaacagcagggtggggtacaaaggctttggaagtcttaaaggtagttatcaaaaaggcagatagttgagcttgctgataaaaatatcagatatttccacaggctgatgaggtccagggagtgtgaagtgtccagcagagaaaggtacgaacaagcaccaaccacatggaaggacactgaacaaagatgaatactgtaggtgaaaagaatgtttgacatcattccaatttcaggaaaatggcaatgaagacataaaaatttggcagtggttacaaaagttacatctatgattgaattttatttctctcataattatgcagtttcaaagttctatgatatttatagataatagatgacctcttattttggacctcctcagccttggacatttctacctggatggattaagttattcgcattttctcccatttcaggcatttctctttgacatattgtgttaaaactatgaagtacagaagaactaaagcaaccaaaacaacaacaacaaaactgacaaaagagaacagaaaaaaggaaatatcttgagaaataaaactgtagttggtactggtatcaacaaaagagtcatgagggaggggtattggggttatcagtcattccatggattgaaaactgtcacaatctatgtggaggatccataggcagttcaggagtggtgacctgttttctaggccagtcagggaactctagtccagtctctcaccctaccatctcctgcttcttctcttaggttttagacaggaactaaagatggttcttgacttgttaagaattctatatacttatcctgctatgaaaatagagccctcctccaagtaatataatccaactaagttaacagagtgatccttgtaagtcatcccatttttctttttcttcttttttttttttttcttttttcttttttttttgagacagggttttggagcctgttctggaactcactctgtagaccaggctggccttgaactcacaaagatccacctacctctgccttctgagtgctgggtttaaaggtgtgtgccgccaatacccagctacaaatcctttttataacaccatttatttaaggtttgaatcaaatttaaagttaaaacagtacaaatgacctttggactacaactcattctgtctaatattgaccttgttaaaaaaaatctatgcgttatcatacataccatacatactggcaacagggtttgccttaagcctttctcattcaccttcctgaaggactgcctcttatttcaaatacaaacagtgcctttttcttggtagtattagcaactgaacccagggccttatgagtgccaggtccaagctctgcctccaagctgcattgtcctgaaatatcaacaattcatctcttgtcaagggtttctctgtgtagccctggctgttctggaactacttctgtagaccagataggtcttgaactctcagagatctgcctgcctctgcctcctgagtgctgggattaacggcatgcaccatcactgccctggtggcctttcaattcttgactcaaagacaaatgcacaaatgaaatgacccagtgaatgttcagagaaataattaattacgtatggtttccttcatcaggaatatgaatacaaatattgttgtattcattttttttgttgttgttaaaaatccgttaatatggaagaccatggctgagctgtgtatggctaggaattcaagaggtatgtggcattgtaattgctatgagaaaacacatctgctaggaaagtaacatcttgatttctaccacattttgtagcaacttttttgaacatccttccttctctgataatacagagggaattaacagaatgttccagagactaggcaatggtgatctgaatgatttggcaaggggacagtgacagagaggaatgagagtttcattttcctactgtcagtttctcatttatacacttactcttggctgtgcggtctgtattgctcagagaaaaccctgtcattgccttccccagattaggaaaatgggtgatatgaaagtttcctttggccgggtggtggtggctcacgcttttaatcccagcactcgggaggcagaggcagtcggatctatgtgagtttgagaccagccttgtctacaagagctagttccaggatggcctccaaagccacatagaaaccctgtctcgaaaaatcaaaaaaaaaaaaaaattaagtttcctttgtgtgctgatggcaggaaatgtctattattttaagaaatgccaaatctgatcatgaataacaaaatgtttttttttttatctgtttcttgtggtttcaagttgtctgttgtccccatttcttcaaagaatcatcacttttgtaagtttgttaatcaaattaggtaggtgtggtggagcataactccatcccagcactggggaggcagaagcagacagatctcagtgagtttcaagtcagccagggttacatagtgagaccctgtaatcccccccatcaaatcatcaaatgttcataaggaaagagatctttaaatatcatcattcatatgatctcaggggcaaaatcggggtctaaagagttaagtcctgagtcctacagtagttggtgggggtcttcctagtgctaggccagggctatttatagtataaggagccgcctcagttgagtatcccaggctaattttgaactcctgatcctcctgcttctgtttctgggaatgagggtgtgcaccagcatttatttatttatttatagatattctatgtggtcctggggataaaatcctgggcttcctgcttgcttggcaaacactgccaactgagctacagtttccagcccctgatgagtattctgaatctgtcataattgagagggtgttttggccacagcctctgtggtgtggggagtttgtgtgccattttacattttttgatcctctactaatttgatatactttgagtttattgtctgatgtttttaggcatgaaagcagtcagtaaaaaagcaaaccagtgcttttattttatttttaaaaatatccttagatttaattcttttatgcttatggtatgagtgttttacttgtgtgtgtatgtgtgtgtgtgtgtgcgcgcgtgcgcgcgtgtgtgcgagcgtgcccaatacccatgcaggtcagaagagtatgctgagttccctgcaactgaagttacagatggttgtgaattgatgtggctgatgggaacatcccgggcttctgtaagtgcaaatactcttgatgttgagccatctctccaggcccccaaacagaggtttaaataagtatttatttgtgatagaatgagtaaaggctggctggaagttagaatatttgcaatcaatttgtcatggagagatgatggcaaaatagtgatggtagtgcggaaggagacacctcctttgaaagcctactctttactccaattgggttatcttatttctctctctttttgtccccttctcaatactctttcaatgaactatttctccagcctgctttttacttttcattttgagactgggtctcactggccttgaactcaccctataagccaggcaggtcttgaacttgataacctgcctctgcctcccaaagtaggtgtgatgacaggtctccacaacctggctcagcttatctcattccttatataagtgccaagctttaacttcattctattactaggggtgggagggtggagggtgggattgaggcgttgggaagttccaaaccccactccatggccacacaaaatggcaggctgcataccgagtagaaccagatccaatacaggatctctgtggtgtagtacgtctggtgaagcaatgaagtaacagtaactgtaggccacacagaaccaggaagggttccaaccatctttagttcacagtgccttacttgttctgagtgacacattctaccagggagtctttatacttcttattaaggaagtggggaagaagaaccagtacatgaagacatttaggatttccgatgctttattttgtttcctaaaaaaagctgaaaggcacagttaggtttattttcccatttatcagactatgatgttctgcatgtatgactgtaaaaatttattcagaattatgatcccagtgtataaacgtgtcttttgggttcaatatgtgattttgtaattaataattattgttcctgtttactaaatgggagttttaatgtttatttccccacccttggttgttgaatgtgataaatttgtatttcctcagggtctccatgaaaatcattattctccatataagttagtttgtagtatgtaaaaaaaccaacaaccactcacttttacacatatgtatcaacatggatttctggagattgcttttatactggtcttaagttcaagttttagcattagccccagtcctatatggaaggagagaatgtccagttctctgatcagaatgctttgtaacataaacgtggtgacactttgcagaggatggctttcttttagtgtgttaacaataatttgcagtgggtttaatacaatttagataaagcgggcgttcccccttccagaactggattgtcagtgactaaaactgtcatgcgaattcacaactccttcaaacctgttactacaaaaacaactattttgttattcagcctaaaaataaaacatttcacccaaactatatgctttaataaccactgtttttaatcgacctgatttaaaaccaatttgtaagaaatgcatttctgcaggtcgcccggagttggaactgggacagaagtttggagggggtgattttaaaaccctttctctgctaggagacacctggaggtcttgggggctcccgaggtgggtggagggggcgnnnnnnnnnnnnnnccgggggggggggggcgggagccgagaggctcagccatatttgatggttttgttgctttgctcaggagttctcgggagtaatgtaatgccgaaggtcgctgcctagtggaaataatatagtacgtcattaatatggcgccaaaagattgggctgtggatctgtagcgcggagggaggaggcggccgccagcgccgcggcactatcccaccagcaacttgggcatcgccgggcgggggccggcgacgaggccaggatggccgcggaacccgagaattgatcggtgttggatcagtaagttctatttcgattattattgttattttcaatcggaggagggcgaaggcttagagcttttccttttaaatgtgcgaatgatatgagggtttcaggtgattcatcaaacgttttcattagcagaaatccagtttagtttatacattaaaaaaaaaaaaagccaaagtgccttaaggctgcatgaaagtgggaagcatagtagcaacttggtagacagatggttatggcagagcgcaggttcgcgtacatatatgattccagagtgtgtgacagtgtgtgtgggggaaggagggtatgagggtatgtttttcctaacataggtgtgagggggtacatctgtgtgaagtggccgcagccctggttcttgtcaccgcgtcaccacatgtccaaaatattcattgcatcaattcaagggcagtgagaagggggcgaagggaaagctgggcaattagatttttttcagaatgggtttttcaatgatgagatcttttacttccagcgagactgcttataaagtgtaaaagacttcgtcggtgaaattgggaaggacttcatcgtttgagcaaagtacctattaatcatgaacttaaaacggattgcagattgcaacctttggcaccatctgcaaattgtggggggtggggtctctgggtctcctcgctgcctttcgtgcacatgcacatgcggtgtgcaccccgggactgcaagttgcaaaatcttcccggtgcacgtgtctggtgcctgtgagtgtgtttgcgagttgggtgctgttgttcggtagccagtaggctttccgggtcggctcggctcggcgtgggcttgcaaatgcgggagagggatggaatgtggaatgttgaccagagaaccgaatcctttcggaacggtcccatttgctggagaaattcgataccttccacctcttacccgccccccctcatcgcccgccttcgggcaggaggcggggctgaggacgccgctgctgctcaaagtggcggagcgcggcggcgggaggcaggtgcacagcacaacagtaactgtaggccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccccatttcccaggcccctttctctcccttcccccatactccccactttccatcccctagagctcccctctgcgggcctccccacttctgaccctgggttccgggcctcccattccgacctcccattccctggcccgggttcccccacccatcctagaccccgagtctgaccgcctccgttacccgcggcttcccgggctccgcatccccgctctggcttcacacccgggctcccccttctgggcacgcgggggcggccgcactcccggcgccggtgaattgctgtgagcaaacaacaaaaaagcgggcgatttaaatgtgccttcgaaaccagttagaactcgtcttctctgggagaccgtttaaaagctgctttaggtgactttctagaaaggtggtggcgaaggtcttccgcccttgtgttaacccgggcctggaggggatttaaaatttccttttgtgaaatgttagttttggcttggccacggagctccgcttttagcaaagtggaggacgacctgaggtccccattcccggtaaagtttgtgtgggtctttcccaaaggactcccttaggtggagtgtttttccggtttagaatacctgcggtggagggtacctctcgctgcttgttgcttaaggctaataatgcctttcaaaggtaatgaactagttttaagacacagggaatagttttcctgaaagccgatgtaagcagtgattcatcggtggttagaccacactagttaggatagaacaacatctacctggattaaggaagagttcattgaaagtaagctcactcacgctcgggatttctcataggtagtagtcaaccacatcttcaggggagatcacatactttgggcagctcagacttttcagtcttttttatcccagagattttagtcccattcactatagcctttttacacatttgaaaatccttattacatttaatattgtaggactgtggttgaccgagggtactgtcacagagaaagctgaaaaatgtgtgcgtgggggaatgtactatgtctctttagtagcactagaggtttatactcaccgtagattcatatctatcttaaatgatataagtgacctcttcaaaatgtcaaaccatgtgtgagttttagcctggttgcctgcatatggatgttttctctgcccctgagattcttccggagtctggaattatcatcaagcactgaagttagataattttttgaatgtttggtgttttatgcccttttgtaaagtttgcaaatttattcgtcttctagaacaaatacagtttccagttaatgtgccagttttcctcacttcttgcccatgtcagatgagtgcatggtcgtatttccttctacttaagagccctgtgctgcttcctagcttaggtatttaattgtcagagaaagctgggtggggactgtacctaagtggtagagcccactgcctagactgtatcaagtcctggattcagtcaccagcacagccaaagaggggaggggcatattctttctccttccatcacttgaagccttgtaacccaggagaaactttactgtagttaccaaggttacaagagtaagtagatagggagtcatccttgtggtacagaagggaaggagtttaagtcatttagaagcaaggtttgtccagcccagtgattttaccaaagcttgtccagcccagtgatgagatgaactaaacatggagatacttcatatgcccccaaggtgatagcccttgggttaagaagttattgggcagtggtgttaacattgttgatactgaggaacaggacacttggctgtcacccaggagtcaccacaggtagaggtgatggcctgtgcatgcacacacacgcctgtgcttgattgaaaataaggtctacatgaatgtctgtaaggtgcccctgtctgctagcttggtaaactttttcattgattactaaggcatatttgctttctccatttgatcctgctgtatcataaagcaagtttctttgaaactgctggcccttgaaggaccatacattgcatctggacctaacattttgacaaaatgcctgatatggagtgaggtgagcctttggccatgaagttaattgggctaaaattgcaactcaaacgtcatcattgtaatttgggaattttggattcggaagtcatctgtttgaaaagtgcttgaaagaagcgttgttgactggtgtatgtatgttcagattgcccaggaaaaaggtcttaagtttcagttgaggtggctggaatagcctgtgggaaagtcttggatggggattgtgtgtttgggagtgaggaggaggtagatgactgatgactgatgactgactgccactgtcacacacccgcttctatccatgctcttctttgtggtttagtattaagggcacctgttacataattacagtcagtggtctgtcagagttggctccgtaaaccaattttcctgcaggtttatagattggatagcccttgacggttgttaggatgttgcaggcaacgtctgaatgatttgaaatggcattgagaggtctggcttggtagaaacaatgagcatcttaaacgcattcccttgtctaggttctcaccttaggaaactggtcctatatgcagtattctttccttactcccgtcccttttcccccattggcacaggggattgcttgggactccttcactttttcatgaagtgtattaacctcctaacattaattagcaaagtagtttaattgtaattctttgtttccctgaaagttttatgtgtaaattgattttctcccctttcaggatcttgcagcgttctgatccacgcatttagaatttagggctgggtgaacagcttagtgggacagtgcttttcctagttcggtgactctaggcatttggatgactgctatgtttggtaactactgtttggttatttcatttattttacccctgtgctgggcgttggacacagtacaggaccttgggtaagtactgtcccactgaagcattctcagcccctgctactttggtatttacagactgtatcttggactgagatttaattgaaagtctcatgtcatttctaggactctcttctgcacaaacttaggtctgtaaagaaggtgtatattttgatttttttttttgaggggggtcagttggtggcactgttggggagttactttgtcttctaaatgcaggcttagccttagaggcccttaccctgcacctgaatgtgacacttaaatttagcagggtctgtgctagacactagcacaagaccttttctagcccaggacttgagtgattactgggaagtttttactcacaagaaaaacagaaataaaatactagacttggactggacagcttggtcctgggggagaggctgcacactttcatcttttgctcctttattaatgctagcctagtggtaggtaccgtgcattcaacagatgttcagagagcagacttggtttttcttcagtgttggggaagagcccctgggcatcttgtggtctaagcaggtgttatacctctgagctaaaaccgcagccccgacaccaaccacacttccagttactctaaacaagatccgtatttgcctttttgctttaggttcttcaggtaaagatacagtaaagtaactgaggctgctaaagttggtttattcttagattacagtttgggtactgggggtggaactcagtctcacacacactaagcactcattccatcagtaagccccaccaccacccagcgctctaagtttgttttaaaactttaggttcttttgggctatttctgaggaaattaaagccatagtttgctcttgttgaatgcactcaattggaataactgaaacaataccaagtgtcagatgtttcctgcactccaagttcccgtaaccaagacagtttctgcacagttattcaaagtgaaggtttcgggggtgaattcaagctgaggagtacatttgggtagcttttatttccttcctactccagggtaagtaccaagcaagaaatagagccagcttagcagcttcttgaggctgaagtgcctggtttgcttccattcagcacatggtatgctcagacaaagtttaaatcttctcaatgatgccaggctctctgccctagcctgggcttgggggctgatggctggtagcttgtggcttccagggtaccctgaaggggtaggaagtacagacttttgcatgttcttttaggaactcaagattcctttaagcatttgaattctggtgactttgtaggtttctcttccatcctttgcttttggtgttgaattgctatctggagtgcttgcttttctgttattagctggaaaatcaggtaagcagtttgttggggaattttcattacagaggggccagtagttccaagcaggagcctacagggtcagggtttgcctttgagggagattcacagcattctgactctcacctgtgtttcagctgctcaccatatcctctggtttgttgtttttttgtctgttttagtttaggacttggtagggactgagcatgtttgatcctcgattatatgttttgaggtccctgcccaggatttggtaattgattcctctaggcagacatacccagtgtttgtacaccacattgccagcatgctgattgatagaaagggccagggagtcagtgtcctaggttctgagtcatgtgggccactgcagctactgagcacctatatgaggacagcacatggccagcaattttagtcttgtatcatttctcctttttcagctatctgaaaacagtccataatccaaattctacaacaggctgttgacctctggctttatactaagacagtgttaacctgtctcctaacagccacaaagccctgagtttagttcccagcaccacataaactaggcatgattatatgtgcctgtaatctcaacactcagaaggtggagggaggagcattagatgttcaaggtcatttgaagctagggagttggaggccattctgggatatatgactgagagtggtccttcattcttcctttatctgtcacctgtcaatcagtcatctatttaaccttaattgactttgttctattatttccgactggaatcagtgtactcagagttgtggtttgaggctccaatgttcctcttgggatgctgtgtgcctgcatagtcacttgtgtggataaggtgtcccgagtgagcagcgtgtgctctgattagattcctccggagagggaggtgatgccaggcagagtgcatgtgtcctgccaagcagtgtgtgcctgctgttctgagggctggcttcctgtggtggctagtgctatggagcttctaatggactcttccagctctgcctttgtatgctatcctccgctcggcagaatggcagtggcaaccacatttaccttagcttgcccggagccacgcttcatttgacacattgctgtttggatttcatgctacttgtctgctcactgataacacaatgtggtcctcagtcttctagagaggcagttcttacccagcagtcctccaggaatctgggaagcccagggtccagggtttagggggaggtgggcctaacatggcaaggggcctttgattcagcttgtgcctttgccctcaacctgtgaattctcttcaagctgctggtcatctccgggattccgggtacttcttaaagtcctgagagtgcaccccagtttttaatctctggagtctgttttagctctgcaattatggctttacggtttcttttggggacttccgtgtagctgtgtggttgtgagatgccttctgcagaccttctgcgaggttttcagaccatctgatgtttctgcagccgtctcagctcggcgtgcagttgtgatgaaatgtttcttctcatgtgaaactcgtgattcgaagtacgtgcttgctaagtgtgctgtcagtcttgggacacacacttctgagatgttcttgcttcctttaggacagtgctataaaggttttggtaacttaacatcgttaggggtaattgatcgcttttgacaattggctctaatcaaggaccaaagttcctcagaagcagctgcatgtcaatctgcgcagcataattgtcattagctgttcgagcctggtttctgcaaaagctaatttgtataaccccagcatgaacatctgtttgagcatttaaaaatctttaaattaccccgtagatactgtcctccaccaagggtgcagtagtgggtttggaatccttcccccacccttacttaccttgttcattcattcttgcctaaaatgtctttggtcgagtgtgacctgtgtgttagaacctggtgcagagacctcaaggcagaatggaatggtaacttttgaatgttttggaaaataagcttttcttgtgtgcctttcctccaggaactcttgaggagtctgtaatgcccatctgaggaaggggtgcgtgcatgtggctttctgtctagaatatgactgcccactgccctcctttctcagagccaccatgacccttttccatttctccaaggttgcctttgagtatgaggaattgtatgtgtcccttgccttcctcccttacgtgtaagtgggcttatttcttgttggaatttttacactcggagcttgcctgctttaagtctgtcctggcacgtccttccatatgtgaccacatatcatagggaaggtatgcctcctagaagaaagtagggcctggaagataaaggttgaggccagggtaactgctgatgctgtttgggtatgaatttatttactttcctttgttaaatgaagttaagatacatccttgcaccaaggcaccaatgacccacagtgctcctgtcacagctgcttttactcagggtgtgtgtgtcccatcctgtccacaccccctcccctttagttttgcttgtgtagcccaggaggccaacctggaactccatcttatgtagcccagactggctgtgaagcatatctccttgtttaacctccttgggttctgagtgttaattgagtgctcagtcacagacctgggtgatgcaaaggcttgtcctaggtgtaagctgtgattgagtcattgataaattggcaagtggagcagcttgtgatttgttctggagcactcatttatacatttcttaagattctcccagctggttttcttaccttttaaaatctgagttcaaacttactggtaaagaacccacgtgagctggtgtttacagggttgtgttaatgtttacaccacctgaaaaagagtgggtaccggttcagttgtcagagttctcttttggaggacatttattgctgacatcaattctacagcaaggtgctatggtagcttggacagcattttctttaaagtttggtatatgacatacattttaaaaagcccgtttattttgactgaaatacttagattggagtgcccgtaagtttaaccagggtctagttaatttcctgattgttttgtattagatatggctacatgtgttctggcttctcattttgtttaaaatgggaaatgtggtgtaagctgttggtactgagcatatggattactgttggtaatttgggtattttatgctcttgctttaagaattgagatcagataccactggggtttcttagacaggtagacaggtttctctgtgtactggttgcttggaaagctgtccgctcctcaggacagaaggtggcccagggggagaactcttttaagtcatcttcggggggcctcactatttcatcttgggggtcagttttcaagtaagactgaaatgtgtgaattcggcaacgtagttgacatgatttcaggtttgtgtaaggtcacctggtgtttgaaagtacattccttaggagagaacgttttagtgacagaatggaaggacagctgcaaggtttacactggcataacagatggtactccagttaaaggtcagttagatacctgagtgagtaaggtgagcctgtgaacgagcataggccatgtgcaggatctcagccatttatccaggaggtaatttcagtacatcacactgaattgggctatacgatggctaaggaagtgtgtggaggttttaattgagtaccttctggaacttcttgccagtgacataaataacaatggagacatagtgcataaaattgacactctgaggaaaaaggcagcctttttgcatatgagccataagatagtaaaatcgctggggtgtgatccttattagggcttcggagtttatggcctgataaacggtcccttcttggtccagtcagtcctgactgtgagtccctttcctaggaatagtgttgaataaacaccctccacattctcaatctttggtaaaattccttctgctctgtctctggggccactgaactctgactcaagttctggggctattttagggtggctcaaccttctgctggctctttcatttcactacttggcaacttcttcagtttcaggcaaaggaaatgcaagcatgaaggtttggagggaccttgctctcaccatgcaaacagcttctgtggttgccccatccaggaagggagcagtccacagcttgttcacattgtagcctcctacctggtgccgttttctttgagttgatgtgtataatgactgttttagcccatgtgacagagggcattgaatgtgttcagtcctccaaagacatggtgccctgaactcccaccacagctggccaactgtcttggcgcatctcaccttgcagtgaacaatgatgccagatggctgtttagtggtccggccaggtctttggccagctacctctttttagttctctaggaaggaccaatgatgctctcaatgaaacccgacttcctagtgttctcctggaaatgcatttccagtacctgctacttagtactatctagctgtcatgtttctcacagcagggggactctcagggctcctggacattggattcctctaagtcaggtttggtggcattgtaaaaagaagtcactgttctccagaaactgtaataatcttcagaacactatatgctggtaggcagttactcttggacctcaaagtgctttggtccttcctctctgtccctgtcaatgctgttaaaggcacagactttgagggagtagggaggaagggtcagtggaatacattgacatgaaagcagaagtggagactggagggagggaggaaggggacaagcaagggggggagggacgatggagagaggagaatagagggaggggggacaaataaaaacaaagtataaccacctaagtgtgtaaggatcataatttaacccattgctttgtatgctaactggttaaaacaccaaaagataggctgagtggtggtggtatgcacctttaatcccagcagaggcaggtggatctctgtgagctcaaggccagcctggtctacagagagagagagttccaggacaaccagggcaacactgaaaaaccctgtcttgaaaaaccaaatcaaaccgaccaaccaaccaacccacccacttacccacctacccaccctgcccaaagatagatggagggatggctcagtgctttagagctctggcttcaccagaggacccaggtttaattcccagatacgactgctcacaagttaactccagttctaaggggatctgacaccctcttctgacctcctcaggcatcagccacacaagcgttgcacagacatacatgtaagcaaaacaccacatacataaaataaaaatggagtcttgctcagtcagttcagtgaaagtcacctgcccttgtgtttggactcttaactcatctggctgggcttctgcactcatcttaccaagttggtttagctagaacctctttctggaagttctctgagaggaacttcacactgacccttcctttatcctcaactgggctgtgtgctgcttttgccttgacttcatcttccctcactgcaaggcaacttgtggtcacttcatagactgccatgttctcctttgaagagatttgccttaacgtattttcttttccattactgttatatttacatttttaattacaagtgtgtatatacatgtgtatgtgttcatgtgtctatgcatgtgcatgtctgtgtgcgagcatgcctttttgtatgtgtgtgtattgtatgtacatacagtgcctgcatgtgtgtgctaattctttctgtctgccgtgtacgttctgggcgtctacctcaggtcttaagacttgctgacaagtgccgttacttgctgaaccatcttgatggacccaagtgtgtgttttttgagagaagatctctgagctcatattgaccttaaactaggaaaatcctgtacctgcctcctgagtgctgggattacacacatgtgccaccacgtcctgctttgttaactgttcaagtatataatgaccttgcacagcaacttaacaagatccagaagaggaaacttgctgtgctaagtggtgcagagtgagctccatggagttagagtggaggatgatgatgtagggcatctttgaacttggccctagcgaagagggcagcagtgcagccttgttcaggccgagacccattccagacatggcatctgggaagggtctgagaacccagtttttttcctcctggcaggttgcactttggctttcagtgtggactggagagggagatttgtggctcttcttgaggacatcttgggtgttggttcatttcctgtcgttggttgtggggagggaatctaggtggaagtgggtgctttagtctgtttcctcttactacagtagaatacccgaggctggataaattcagggcaatagatgtttactaggcttctggtttgggaggctggaaagtccaagaatgaaggactgcagctggaaagggccttcctaagaaggtagaaggtattccacggtgagtgcggcaaacttgctaaattcacttctgtgatacccaccatggaggtagcagcagtcatgagggttctgcctttgaacatctccatgactccccacctctctacactttagttcagacatgttttctttttcaatgatgaattcaaatcatagtggttgaagaccaaacccataatagggggacttgacagagttacacaatgtcaatcaatgagctttggcaatcacatataaataagaaagaatatctaggagctgttcttccagaggagctgggcttgaaatctagcacccacatggtggctcatagccacctgtaattccagttcaaggggagcccatgtcctctcactctcttgatctcctcaggcaccagacacgcacatggtgcacacagtcatatgcagacaaaacacccatacacactaaatgaaaaggatttctgttggaaaggaaaatactgacgtcttgagtatggagatggtgccctgagtcatacatacagagatgctttctggctgcctcatcttggtgtctttccttgattctttgaacctttgggttcatatagacttttgtgttgaccactgttgagtaccggggatgctggatttctgttgtttgcctgttttcatttagtaggccagaagcttctcgaagctgggccccgcctgttcaggtctttgtgggtgcctcgcctgctggaaggtgtcttaactgctttctctggagtgttgtgagtagccctttcaattgattatcacttagctccctaccatctgtgtaggtagcaatcagctagtgctcccaaagtcagggatagtgacgcagaagctcgctccttcttgctctggcttttagtggacagatgcttgcaacatacagcctcctgtgtgtgttaaagatagtaactgggactttgatttttctgatacagtaagtaaccctgggtgagataaatcagcctcatgtcaaggtttaagtacattagagccacagaagagggaattttgctgaacattagcccccaccacaggcagagcacactgtgctcaactctattactcagggtcttcagggccaacaagaatggaattcctgagaaggaaaatactaatttcacttgtacttcagagcaccagtctagcttagagtttcatctgaaagctgggaggaaggcattttgatgggcagtgattgattccgagatttccaagccattctgtgtaggtaaccgtaagctgactgagtcagtgaagatggagcaagtgctgctccctaccttgtttggcagacaagttctctgggccttcccaggctctcccaggctctctctcatctgctcctgaggtggtgaacttccttcaggctgggctgcatagaactgctacttaaggaatccctcttgtaggtggtgacttttgattttttttagaaaactcctttaacctgttaggctttggagagctgaagctgttgtgaggaatgagaggtgtttcctggtctgtccaccccccaggggagcaggggtgtctttcctttagatgactaaaggaaagggggctttggactttgaggaaggcaagctgtgggaagatgatgaccttgaagtttgaatggttggtaattgaggattgtgtatgaatgagaactgttttgtggggcacctctataagtggaattacctttacaaaagggaaatttatgtcttgctgttggtcagggagggtgaaggcaactccaaataacccttagaccaaagtggcatatttcggtcctcttgtagtctgttgtttttctgcctcttgactgtccttttacagtctgtaaaaggtgcagtggttgtccacacttctcttctttgtgtgttcactggaaacaaaccttattacatgtgtggtgatgcccagcaaagggggattagttggatgggtgggtgaagggctgccattcttctggcttgaaaagctctcctttttctttgggagtcattgatatgacagtaagacaatggcccccacagatggcaagacaaaacttttagtttggaaaagttttttagacttgttgaaagtgttgatttacctgtctaagtagtcgatgcccactgccctctttgatgaagtctttttcttacctgagatgcactggagaccttcactgtattagctggagggctggttgtgtgggctggttttcttttcctttttttttttttttgtgtgtgtgtgtttatatgtgtgtgtgtgtgttgcctgattttctccctcatccccccctgccgcccagacaggatttctttgtagctttggagcctgttctggaacttgctctgtagaccaggctagcctcaaactcacaagatccgcctgcctctgcctccagcgtgctggggttaaaggtctgagccaccaccacccagtaaaagaaaagatctttcttttaaatttaaattattattatttttaataatttatttatttatattttatacacattggtgttttgcctgcatgtatgtgtctgtgtgagggtgttgaatccctggaacaggagttacagacagctgtgagctgccatgtgggcactggaaattgaacccaggttttctggaagagtagccagtgctcaaccactgagccgcctttccagctctgattgttttaaaattagtttcgtttgttcatatttgtcctgaaaagatttgagtaatgaggagttccctacccagtgtgaccttggagaagtcacttgtaaaggagcaaaagggagggttctgcatcagtgttcctgaagctgtagtgccttccagttctagctgtggacttctgagggggttgcaggtgtctcctcattaacccactgactctttctagagccacaggttgttacttagttcatcttagcaaaatttggggttcctttttaacaaaatttccaaaagaagcctaatcatgcccatccctgcccccaacatgcacatacagcatggatctgtctggggagggagccttactccttgctgtggactgctgtctgcagtgctcgctgctagggctgaggagactcctggagtagttgcagtgatgtctggggactgtggagggtagggtggcatctctgggagacctgcccacgtgtgactttactcctccctcgactcttaacctggtctgttactgattccagctaattatgtgtctttggtcttttcactgtttgtaattcaaatgctcctcgaggccctatgtttgcttttgtttgcagcatcctggctgccatctgaagcacaacttgatgatcgctgttaccatcttgggttaagtgctgtctcattgctttgcaggctgcctgctgtctcccggggagatcatgaaacgaggtcgccttcccagcagcagtgaggattctgacgacaatggcagtaagtcctgctttgttgttcttggagcctgctagggttggggtcagtgtgcaaacatgattttttaatataatgctttgaatagccaaggccttttgcatatcgagcaggtcagagaaaggcaaggcctggagagaaacacatctgagtgtgatactgcagcgctgtaaccagatctgtgctggcaaggttggctgcaggcaggccttctacaggcttcctgtgtgttacgcagggagaagaattcagttccaagagccactggtgtatctgttttcattaaacatcatttatgatgcctcacattgctctctatgaagagggaacttaatcaaagccaggtaattattaactagctcaacctgcctgggcctccaagggcaggcggagcactgctcaatgtgatgtgagggtaccaagtccaggttcttcatagatggcacgtgagtctctgccctttcctggtttaacaggacggtgtttagtgctgtcactgtctgcatctcagctctctggcaacctcagattttcacagtgtagctgagaaccaggagttagttggcttccaggcagtcaaaataaatgtcacatagtgtctgtgttgaggagctaacagactgccgagggaagctctcccttcagactgcagcagggaattttgtacctagctcagtgtctgcactctagcccattagcttaggtttgacattacacattaaactctggaagccttgaaagaaagcttgctgtactgtgaggcgggaagggagccaggcctgctttctaggcactttgcctcagacattaagaacagttctgatgtgaatacagatctcatgatgtgctgtagaagtggtatgtaggaactcaagagaggaggtctgggaagacccagggaggagacaatgtttgggcaggtcccagggatgaaaagctttgggcagatagggtttttgaaggcctgatgtcttaggtggtcagcacgagtgtggtttactgctgtggacagttctggagaaggtgggagtgccacaaacctgaaacagtcatgcaaattttggctgtatgagttgtggctgtagaaatcatggagcagtggtatagacccaagagagtgatggagggggcagtgtggaggtgagctgtggtcagatctaacagctggatgagaaactgaagcaagggagccactgtgaaagagaagcaggagtcaaggaaggcaggaagttgtatccaagggaaagtttttctcttacttcctagggggctcttgaggtttccactatacatgcaggcaggtaaagccacacgtgtgagtttgggaacaccaagttggctatgaggccctcaatttgagcttcagcttctgctttttacttcccctggcaaaagtctgctagcttttctttgtgacacctataaaagtgctgtccctgtctacttttgtcctgaagctttttttttttttaagttgggctatttaagtttagaaagttcccattgcaagtttgttcagggatggcaaagggtcgagttgctgttgagcttggcagcctgagttccatcactcagaccccaacagagaacccattcctgcatgttgccctcttacctccatacatgtgctgtggcaggtgtgtgtgtgctcacacatgtgcaagctagcacatgtatacatacacacacaaaataaaagtgtccatcccaaaaccgtggctgtgatgggccatttcctttctcctctgatcctgtctgttcatctgggaggttcaggtagaatgccaccaagcacagctcttggctccacatgggtctctgatgtggttgtgggggataggaaaggcagttgctagaaggtcacctgtgtatttgccgtgtagttgtttcagtatagaacatatggtagctggtggtgcttcatggctacctacctggtcaggcttggtgacttggcaattatggtgagtgatgatagtggtgagcaagtagctcttattaaatgccaggtcctgtggcagtgtctgcatagttcagctgtggacttcccccagtcctcccttagctagttcatggtataggcctctgccactaagccattaacttcattgggacccctccccttttatacactcagggatctggggaattttttgctcttgcggtgaggtccacctgtgatagctttccatgtcctgaatcttgtttacagcaagggtttgtgcagtggccacctcccagcctgtccagcctgcaggcctgccaggattttggcaggatgttcaagtggaggagaggcagctgcagacgtcagcatggggccaccgcaccagccacagaaggagctggggcctgctggcttctgctgctggcttctgagtctggagtccattgctttgtttgctggcctggccctggggaatagcagtgtggtatttacagttggggatggatgggccttttctgtgccaggtgggtgccctcatctgctgtagtcatggttgttggtctttatccagccgctctggaggcccatccctgcagttggatggaatagtgctggggtgtttgtaggcagtgtctgtaattgctgggctcttgggactgggtagtccagccaaagtctgaagttataccctgtgcctaggtgtggcctggggaagcaagcccttaacttcagcttccaccccagggtccttagtccttaggagtctggcaaaggtgggagtaggggccagcatttagtttcattatttctaaagatttcattttatctgcaaaggctaattagaataaaacatccctttttgggcaggaatattactggttgtcaggctaattatagttctgatctatagccttacatattttccctataaaagtaagaaaaattaaatactgttcaaggaatactgtcaaaccttctgcttttcagaaggtgggaatagattggacaatagaggttgacttcgggagttgtggcaggtgtagggccccctcccagcatggacaacaggttgttctgatgctatttgcgtaacttgacttgggaatttatgtggccattgctttatttgctcagaggcaatgtgctagatctgcaccctgattctggggtgctggcccatggcactcagtattgctagaaatgtgttacatgttaaagtattactacacctatgttatatgttaccttgttttacttagaatgatggaagcttgaattggtcatgaagagtcaccattggggtagtgggggagggctttcgtggtctgtgttttgtgatggtgtgaacacggtctcccgttccccaacctttcttgcacagcgtaatcttctgctacctcttatttttggaggtggcagtagggcctaactcagagccagaacagcttattacatgcaacagatccaaagctgggaggtggcgtgtaatatgcattaaatttactcttgaggcttttcccttattttagctctagggcaagccagcagggctatttttaatatttcagaggggtgtactggtggtgtctggcagaagcagaaggggcttgatgcttgcatgggcaggacttgctgcctgctgtgatcttggagccttttctaactgtgctagcctcaaatgttctgtcctgatgaaagctgggcatagtaaaaannnnnnnnnngactgcctattcttttcagtgtttgagatagtttaacaaggctgtttttacttgagcagtgtacaggtagagattttaagtcagatttgtcaatagagaggacttagctttaggtgtcaattacttaccatgaaaggccataattttagacatcattgcaaagattattatttcttggtgaaggcatacagaaaagggaacaaagatttacatattgtgtcttcattttgagactgagtctcatgttgcgcaggctgccctcatatgaccttgaacttctgatcctcctgaccctacctcccagtgttgtgatggcaggagggaagatgcatttcggtatcctgtagtttgccttcagctatcagcagctatcaggagaacagagtggaacactggctcagcttggtcaccgctgcttttagttttggcaggtgccctgtctttgctgtagtgtgagttacctagattttgaggcttctcatttcctgtttgacacactcccttctgaaaagtattgtgtgccatgaccgtttaattagtgaggaatgtaaataattactattactcctactaggttttttgagactagatcttgccgccgcacccaggccggtcttgagcttccgctctgcctgcttccatcccctttgttgctaggatggcagagcattgcatacccagtccaagctgctgctgattttggagtaggagcatcccgatgatactctccactccaaagccacaaaggcctggagagtacagcacaggggagtgtgctgctttaataacagccaggtagtagcttgagtccttttggatggtcaggtggtctgcaggagagcccgactctcctgctgctgaatgctctcattttctgggagctcagaaacatctttgtattaagtcagacaggagtctgtccctgtgcctgctgacttcagctctaggcttacaggaaaccctgtgtgtgcatgtactgacaaactctgtgctttatgcttgcatattctctgaaacagggactgtgttgaacaggaaggtcagaggaaagaggtctccagcagagatgctggagcagggaggttgcccttgttctctggggtccccatcaaagtcttggatttctgtgtggcaggtggccgctgtccttactgagtgagaatggtctgccgtgttagtagtgatggccttctcatggtttcctgatgggtaatttatgtacagcaagctgcacatattttaattgtgtacttggagaggtttagccatgctaacatttattatgtcatccagaatcaaaataatctgtccctccaacttggccccaggcagccactgatctgctgtcagtctcgattagtcttccttttcctgaacttttacatcagtgcagtgtaccttttcctggtctggcttctttcacttcgtgtaattatttcagtatttatccataaacagtgttcctttttattgctggctaatatttcattgaaaggatgtgtcagaattcattttatccctttgcagtctggtggtggatttttagattgtctctgggtgtatttattattattttggggggggtcataatgtatttacatcatttttcctttcacttttcttcctccaaatatttccatgtgccgtatcccccctttcaaattcatggcctcctctcctttattgttgttgatatatgcctttctaagtgtataaacagaatttgtccagtctttataatattaacttactataatataattataaatttatataatattataattatataagtataattataaaataattataattataagtgtatgatgtttccatggccgaccatttggtgtaggataaccagttggtgtgctcttcactggggaagactgtttcaattgctcgatgaattcctttgctacctgcaaatctttgtctagggttcaggcttcccccatctactttggcatgtctcttgctgctcttgttcagctcatgtttagactgtcatgtctgacataggatataatctcagagcaaactccctggtcctctgactcttaccgtctccctgccctctcttctacagtgcaactgggctccacaactctgcattttgattggttgtggtctctgtctgcaaagaaaacttcccttgatgaggggagagaattattggtttttagttgtagtaagtgagctattgaaaatatgtcagagataatttgaatttaagttcttttccagtcttctgaaaataaattttaaagggaagtatgtttcttgtgctcattcttgtatgacattgattgacaccaggtaaagtaagagggtccaactggttaatatggggcttgggtgtctttctttttgtagccttggctgtcctggactcttgatgtggaccaggctggagatccacctgcctctgcctccctgagtgctgggattaaaggtgtgcaccaccactgcccggcttgggtgtctgttttaaaagcaaatgtagtataagcagtgtttcaagatttacagtttcttagttttgcattctgagcccacacaatgatagacttcagtggaagctcggactgcttgggaggggtcctgacatcccaacaagacacagagaagtgtggaagccgagaatggacaaactgtttttctccacttcctgtttaatggctaggtgtaaagtattgcaaaggaatgattcttctttaaagcttttgcttgttttattccagatgtataactatttccagagcaatttagagtccagggttttggctgtgctcaagcacttgcccagcacatgcagagcctgtgctccatccctagcaccaacaagaacaacagaagagaccattattttctgcccaactcttggaccttctgggaatcccatgcttacctgtgcggggcccccccctttttttttttttttggtttttcgagacagggtttctctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgtggggcccctttttttttttttttggtttttcgagacagggtttctctgtgtagctttggagcctatcctggcactcgctctggagaccaggctggcctcgaactcacagagatcctcctgcctctgcctcccgagtgctgggattaaaggcatgcgccaccaaagcccggccgtgctcccttcttttacagactgtggacctagattatggcttcctaagattttttttaatgtttttcttttttaaaatgtttattttatatgtatgggtattttgtctgtgtactgtatgcatgcctgccaagaaaagggtgttaaagcccctggaactggagtttcagttgattgtgacccatcatgtgggtgctgggaattgaatctggatcctgcaagaacagcaagagctcttaacacctgagtcacctctccagcccttaaacagagttgtctctccacaagtaactgaatgtgggggtcatgaaacattgggtaacagtaaaaagtttctaagtgtacagtggtagaaacgcaaagggcaaaatactgatcaaactgaaaaatgtagattctctgtattgtggcatatcaaatattcaaacaaaatttaattctttacataaaagtaccacattttattagtatgcacatttgcttttgtcaataaatatagaaaaatgtgtatgctaatagatgtttttaagttgaatttctttggtttatagttggcaaatgtttgatttctttttttttttttttttgccatacctaacaagggtgggtgggaaggtgtacggatccctgtgctagaggaaggccttggcccacagagtcctctgtgggcttcagggaccacccagctactttattctctgtgatgaccagcctgtaggtttgcctcattcctggtgtgctcactctatttcctgtgtgtgggtgtgtgtgtgtggggtccctttacattttgaatcttagtaccattattgctgcgcagttgggaatggaacctagggcctgtagaatgctagacgaacactgcactgtacactaggctacacatcagcctcacttccttctcaatcagaaaaatcttctgaagtagtcacaggaatgtcgtgagtcacctgtaagtctcattccatggaagttacagcagctagatgacttacttagtaaagggtaaaactccctgtcagagtctgcagtcctgtgagttgtggtcattcagaactgggtgagaggcatttgtgcgggatctgtcctaagtctggccgcatctgtctatagattctgtggcagtaagggcttgagtgacaagtggtttccctggtaaatggtggcttcttgggcttttgctttttaacattgttaagttttgtcagtttctgagaaataataaggtagatagatgttcagtgcacggatgttgtagttacagaaaggagactgaaatgaattatcagcaagttaggcaaaatgtgaaggtggttgggacagcaatttctgctctggctgcagttgtgtgcgcatgtagcagaggccattgtggttgtccacctgacagactagtaggaggcaacggcagtgatgggggtgggcaagaggagctagtgttctgaggcattggaatgttagcttgtttcttggctactgactgggtgtgttctgagcaggaaggaggagtctagatgacttgtgggtttctgacctcaagtggtaaaggtggtaaaggtggtggactcgtctcaggagggatagaagaggtcgaagtagctcaagcaaagcctggagcttggtttttatgttgcagagttagcagatcttagaatgactgagaagttgatgtctaccaccagtgtgacattgggtctgcattgtgttcagagggaacttagtcattcttagactaagctaagaatgtcacaggcttgcttgggtgttctggttagagtctcagctatggaggagctgcttggaagtagagaaacccagagaataaggaccccaggaaggaaggcaggcagtgtggcagaaggggtatttcaggcaggggatgctctcagtgctgcccagaagtttcaggctctgggagtgctcagtcagctcagtcttggtggcacttaggatacctgggtttcctggtgagaagccatcggagggggttggagcaccttgggggagaggtgcagtagtgcagtaggtgatgttaaataggaaatgctaaatttctatttgtggaggtagacttttttaatgttttgggccatagccttaggttgagcccagtgatctggcatagacactttaatgaagaattagggaatgttttctaattggttgtaccagtgtggtgcagcctccactcctggagtatgctgtggtgctctccctttttttctgttcacgaaacggagcaccctgcacacagtcaaaatgacaggaaagaaggaaccatgtgagggccggggatggcataacaggttgtcactggaggtttattgttggagtagaacccccgacagtgacctgcacagttttttcttgtctgtgtgctgtgtgtgtgcatacatgtgaggatgtgcttgcctgtgtggacagatgtggtgaccagaggttgatgatggaatggctgcctctctttttccaccttactttccaggcaaggtctttgactaatcctgaagctcaagagttacacctagcctggctggctggccctgcttacacacacagccatgccagctttttcctagggtgctggggatctggactcaggtccttatgctcttgcaactaaactagcatgtcaccactgaaacactgaccctgtgtgtgtgtgtgttttaatggttcctgttttgatatttgtttccttaggcttgtcaacgacgtggtcccagcattcccgttcccagcacgggaggagtgcctgctctagacatgaagatcgaaagccttctgaggtacttctggcttgccttggtcatgtgtgctctacatatgtgtgcatgccaacctgctgcccacatgcctgcctcatgctgtgcaggtctgggcaagttacgttaacctctgtgccccactttgtaccccgggaagatggcaagaagcagatgtgtgtctcattggagtctctggtggaataagtgggctagtacacataggttcatgcatgccaagcaagtggcacgtatatagtgcactgtgaatgttagctattattattaattgtattctttttccctttcctgttctgtcttcgctggctccccacaacttttcctctggccaggagatgagcgggttgagctgctgccaagtcattgccagcctcaagttagttttagccatgaatttgtggcttatttggcaacaacccaatgtaattttggaagttttgttttggggattatgcttaaggcttcccccctccttcccaatttgtttcacattttatgtttccctggtgccctacattttgttgttcattttccctgctaaaattgtttttagagatatctccctgctggccttagtaggttggggcccccgttgccctgagatctgttttctctacaaccctccttatgctctgaggattcaaagccaggtgtgtgagcctgtcatctttctcagggaaagccgtgggaaatttctcttggcataagccaactgggatgacctcagttggcttatggtgcgatggctacacagtgacaggtgtttctctgaggcccttcccaggctgctctaggatactggagaatgatttgtccaggagcagaggagtttcttggtgatggagtaaaaccgcctaccagaaagtggtagagatgttccaggaagtgcttccatgggctggtgtgggaaattcgatgggccttgtgtccattttgaccttcagtgctcacttcactttttatggccttggaacatctctgctactgtatttacttctcttgttaaatcctgagttgtctctgtaagtgcactgaacctttttgatgttcatacggctctttcttcggcctctctgagcagtaggcatgtattctgtcctgacccggtttgtgtccagtcctgtgagagcaaactgcttcctgtgtaaagcacctaggttaccagtcccccttgcccttggtctactccaccacctgaactttgggccagagcctctaccaggtctctaggaatggagttagctgccttttctcatctccttcctttggcagatttgcttgtttttttctttgtacagcttagctgcactgttttacctgatttgccttgtaaaggtatggactcagggctttgaccctgaaggcctttctcttggggtggggcagtattaggcttatctctagatccaggggctttgtgtcccagtggaccttatgtcctatgtgccctttgcagaaggtacatagctaggttattgcttgaagggctcctagaagttagaagtggaatcccgggggaagtctagtactgaaaataacagccagaggagtggcctttttagttagacactacctcatttcttcaaaagaccaggcatacagtgtgatccacgcttagcagcaccaggaagcttcctgtcctgaatgagggagtaaggctctgtacacggaggacagcctatagattcaggctcattttgtacctggtgtgtggtggggcctgctcatgccgaggtcagagatccttgtgcaccctcagataagtgggctgaggagaaggccggagagggaagcagctgtgtagccctggctgccagacaagatgtgctgtactgtcggtcaccatggttgatgtggatgccaagtgcccatgagtcccatgccagggcagggagcagaggtggggggtgcccttcctgcagtacccttttgtttgttgtttcttcatgatgagttgggcactttcttggtagatggacaggagcattgcgtcttgattgctgtaaagacagggttctgtctttccacagacaccgcttcctgggtagaagttatgacatcccctgacttggttccatagtgacctgttgttgggactcctagatgtttggtttgcaggcttacattttggcctggtgttaacaaacgtgaaccttgctctcactagccacctaccctaaatgctagcacctcaggaagtggtctggctggcaagttagtttagaagctagtgaactctaccaggtagttctggcttttgccttgaggttaattggctaatgaagttttgtttttaaacatgggcactaaagagcacacccgagtgacttgtcatccttccctgaaggatttccaagagcctatgttcagcagcccttggtgaattgagaggtcttagagaggggaacagttatgtagatatagttgctgctgcctctgcttgtgttgactgagggacctggagccacccaggcctgggtggggaaaggagtgtcaggtgaagggtttctgtaataaggccgacttattctgtgttaatacagtgaccttgttatgggcggctctacggtactttgctgctgccagtgctctgaaatgagtgcagacatcaaatgccagtgtctctttctttttccaggtgtttaggactgacctgatcactgccatgaagttgcatgactcctaccaactgaaccccgatgagtactacgtgctggcggatccctggagacaggaatgggagaaaggagtccaggtgcccgtgagcccagggaccatcccacagcccgtggccaggtagagataccctgaggagacacacatacttctctttccaccactgcttgttcctccccgaaagccaggagactgagaggggggttcttgagttagcagtgcgatgccatgaggcctgacaagaggtagaagtgtggtagacacaattgaagccctggtgagccaaagggcagtgggcttctcaacttcacgagacatactgctttcttattggagaatagaaggtccaagcattttagggaatgtctggctggggccgtttctctctgtgcattacatatgactcagagtggttttgtgggagcagtgatggccttggcgcttcccaggcctgaagtggctgatagtattttggagatgacagtggcttagatgaaggatttgtttgattagctctgctatggacaggctctttctggatgccggtgctttctcttgacctcctgccgcgccactcacctttcacagcttgtcttccttgacgttcctctgagatgggctgtggcatgttggtactttttccccactgttatccttttggtgtagtttgtcctctgagaggatggagtgcccagtagctctgctggcatctggctttgctgccatagtatccgctggctccttgctgtgtgaaatagcttcttttattgtggacaagtatggactaaattcacctcttggcccttagtccgtgtctccccacacactcgattgatttgattgtcatcgttttgggatctctgaagagtatggaattctgaaggatgttcaaattattgtagtccactgtggctaggcaggcataggcgaccactgagagtcacttttagatgagggtcttggcctgtgaagcagggctcatggagtgccgggtgcatgtagtcccctttgaccagcaccaggaggctctgagactaggaggcctgtgctggatggttctgtgtagtgctgagtcagaatggaaatgcctgatagactggagctttgcactcgacacctgctcttgctcaagtaggagatatgaatccctttagtttgctcatctctgtcacacaggtaagttcctcccatcagtttcagggtgataaaacctatgaactctgggcaccctgctggcgtgagtgcccatggtgcagaaacagacgtggaagtgctgtgatctcagcctctaatgggctgagagccctcagctcctgcctggagctggtttgctcctttttcgtgctgtcccttagtttgtcgagggtgaagttggaaagcccttctctgggtgttaacagattgtgagagaatgatagtagaagaattgttctggggtcatatattcatggagtatgggctctcactcttgggattcttagtaatggcaacagcctactcactgttttgctcagtctttttggaaggtgagggttcagagctgtttgcagcatgtgctgtgcacacctagcttgttgctgttattgtcatttctgttcctgagaactctgcttagcaaggtctgtctgattctaacaacttccagggagaatgagcatgcctgtttaacaggaagggaattagaaactaagtatggaaaattttattttattaaaaattttattaaaacgtgggctttggaagcatgggtggtggtagggtagggttgtatgctaggaagagcagcttttgaggactgcaggatctgcttccgctttggcactgtggcctttaatgatttctagctggggatgttgtgatatttgggttttaagcccataatctttatgagtgtaggggtggtctgggcttgaggattggaggaggaagtggtatctgggcaaagaaactttcttgtacatggcagaaagggtaatctggctacttgttttcttgttaagcagggttgtgtctgaagagaagtctctcatgttcatcagacccaagaagtacattgcatcttctggctctgagcctccagagttgggctacgttgatatccggacactggcagacagcgtatgtcgctatgacctcaacgatatggatgctgcatggctagaactaaccaatgaagaatttaaggagatgggtgagactgtgttattacattagttcaccttgaagaaagatctgtttctgtccatagtgattcatagagtcctgtgagaggttgaagcccacccagtcatagctgcttttgtcatctcagaatcccagctattcagagaccacattatctgattttggcacatgtgatgagatgcggagtctacttggagctcctagagtagtggtgggctgatgagggatggttccctgggtggaagcctggcttgttttggctgcagtgactggattcctgtcatgctctgcccccacccctgagttaccatacaggaagagatcagtcagaggtctggtccagtagcctgcccacccacactttgctgttgtgatacaatgccactttttccccaacctgcagcctgctgtttctcagagtgagccttataaagcccgctccaaaccctcttgatttttacctctttacactcttctgagtgacgtatggccctggctgacagtgtggtctttgatggtttctctcctgggaccttcagacttcttacctgcatttcatggtgtggaggctgggatgggacatggatctcctcacattccagccttcctttcccatggttgttctgaatgtttgtcttcaatgtctgccctgacacactggactctgcatgaatgactgcattagtgttgtagaagcagggttgggaagtgatggcatgggctgtttgtactcaagctcataggaaagagtcacatatgtttgtctgccaaggctggaagggcaagcaagggctgtttggagtttgtgttccatggagcccacctcagccttaactccaatagcagcttgtcctcaacagagtcccacccagttgaatgggactgactgttattgagctgggtatgttggtatttcctactggtgagttacttagatgtgttactaagtagatagatgttcctgcttttgttccctgttttaagtattagtggtcagaacagtggcaagcctggagtcgttttaaaatctctttagaaggctctgggggggggtggtatattctatgtgagtggtatattatgtttggtttatatatctgagttctataatatgccagtgtagaaggtgcagttctgtcttttgagctgttcaaatgctttacactgtttatctaaaactgctaaagagagtgtgaagcttttgaccatctgtaggtgtccgtccagtccagggtcctatccaaagactcagccgaaaatctggctttgcagtagtttaaatcgtaaggactcacttggctatgtatggcattaggtaacatgaactaacttggcagaataagtcatgtcctttgatagagattgaacaccagtttaaagatgtttgttccagctgctactgacctttctatggtaaaggttcattagaaggcaaagccaagttaggtggccctgggtgaaaagcaccctgtgaaaacatttcataattttaattagttgcttcctgaatgtgtgtagtgcttaccactatacattctcagtatgttctcccttaaagaagagattgatctctctgtgtgtgtgtgtgtgtgtgtgtgtgtgtgtgtgtgtgtgcgcgcgcgcgcgcgcgcgcgcgcacatggtatgggtgcatgtgggtgcttcttaggggttcagaagaggggattggacccctggagtgagtggaaattccaggtggctgtgaactgccttacattgatgctaggcactgaatgaactcaggttctctgagagaacagctgctttccagccaatctccaaaattgtaaacttgaaaatgtgatggttttcatttttataataacacatataagttataggctcaaattattttacccccatctttaagtttgtccccacccccttccatatctcataatatagcacatgctgtcctgagactaattattgttgagttcttgtattacaggcatgagctccatgcctgactcatgaggatttcttacagaacttctttcttcacaaaaattttcattataggcaatttggagaacatctgcaaatagaagacaatagctcttttcccaccacttaggccacaatagccactttcgttcgtgtgtgtgtgtgtgtgtgtgtgtgtgtgtgtgtgtgtgtgtgtgtgttgttattgttttggctttctttttgcaaggctttttaaaaattacatgcatgtatctgtgtgggtgtgtgtaggtgccagggtaggtcagaagagggtttcagatctcttggatctggaaatacagacaggcaattgtgaggcacatgacacaggtgctggcaatctagctcaggctctttgctgtagcagtagttgctcttgaccactgagcaccctcaagttatttttcgtggttcttgtagaagtgtgttgtattttatttgacggatagtaaactgacttctttgctccagacatttcttcctatttgcctttggtggatctgactatgcctttgagcttggtgaattcagagtggagagggatagaccagttaaagacatttggatgttttctgtgaaatctgcttcagggcactgttttaagcagcaagaaagaaaattaaaaacaaaacaaaataaaaacctcaaaccagaagcaacaaaacccaaacaccatagtatgtggtcctaactttctaagttaaatttgtgtcatagcaacagtggtgcatctaacagtgtgtgtagttatatcctggcctgcctctgagatggttgggagggcttgcttctttattgcatctttcataaggaacactgtggaatggtgtttatctgtgggttggtctgagtcacttgatggagatttctctggcactcagattttcttttatgttttatttaggagttttaacacaccagtgttatttcattatatagtaattattaatgtgcacttagtcaagtgtcttgtgttttccttcagggatgcctgagctagatgagtataccatggaaagggtcttggaggaatttgaacaacgatgctatgataatatgaatcatgccatagagacagaagagggcttggggattgaatatgatgaagatgttgtctgtgatgtctgccagtcacctgatggcgaggatggcaacgagatggtattctgtgacaagtgtaacatctgtgtgcatcaggtaagtctagaaagagcccagaaagaagtttcctggagttctgggctgagcctatcagctagcctgtgctttctggagtccaggatgcttccaaatgggggcccatcctcacagatgtgttctaggaatgttttattgccatccccaatcccaggggataggtctctacctttacaacctgaaggcactaggatccaagtgggaacactgaaaaacaaatccttgaaaagggagttaaactcttcattagtttcctaagtaccataagtggggtgactattcttgtcagcccttgatgttcttggtttgtagctgcctttaggactcatgtgttttccctgagtgtcttcacagggttatcttcttatacaatccctagtcctgttggattaggtgcctgtccacaacagtgtagtctcattccaagtaacagcatgtccagtgactattcctaaaggtcacttttcaggtggtggtagagacttgagcctatcttttggataggctatataggctatataggcttgtaggataatctatagcattaatatgtgtttgcatataaacttagctatcgaaggagggtcaggcactccttttatttttcattttagactttacttttatgtgtatatatgttttacctgcatgtatgtctatataccacattgtgcctggtcccacagtggtaagaagagtacatcagatctcctgggacaagacactgtgtgggtgctgggaactgaacctgggtcctctacatgagcagccagtgctgttaactgctgagccatccttcaagaaccccttttcttgatcattatttcaagatgggagtagaatatggtggttgtttgttactgtcttttcctgcagtgaaggtgggcattgggtaatttacaaagcttaatcacagatatcgggcctctgacctctcatttaacttaagagatttattattactaatttattttttatgtgtgtatgtctgtgtgagtgtatgctcaagggagccccaaaaggaagtcagagacagtcccccctggagctgggattacaggttgtgagctgctgtgagccaaacttgggttctttggaacaacagtaagtgtttttaaccactgagctgtcctcaaattatttaactttttaatacagtaatgaagtgatgtggatttgtgtggggacaagtgtactatgtacttttaggatttagagagctgtcctgaagtacttttgaggccaacagtgacactgaaatttaaagcaaacttaggaaaagtggaagagttgcttgggtgacctgaactttgttttttattattgttctttggagtcaccctggccagtccagagctcaatatatggaccagtatagcttccgactgagacaatcctcctgcctctgcctcatgagtgctgagattgcccatgctcactttcataccctggaggtcttgattttgtctgtaatttacctctagggctttataaaactgaggactatatcagctgtggccttgtctcagcttgttttgacaggagtcttgagaccataatgttcattttgtatctctggactttcaaatggtccagagagtatctttggtggtggcttttggagtccctgtggtggtgatgtgttaagatgggaagccgtgtaaccaccattgttgctggtactttttgattacctgagtgaccctgtggacatttgctctgttacaagatttctgcttgaaatctagctgtgctctgtgttttggaagtagaagttgatgtcaggctgcctgccagtgcattagcttggaggtggcagagttgtcctggtactcaggcttcggtttcttctgctcttgacacacttaatgttcacttcagttttcttttggtgaaatccttcatgatttgtctttaaggcatactcaattagtgtagatatgcctttccagcaaaggaaattctcttcaaatgcaactctagaatgccagatgcagaaccttaatgtttggagccttcatagtattgtttagatctgctaacaaaatgtctttttccagtagactgttgacagcatcttattcatggcctcagtgcgctctcagggctccagtattagtgttcctttgctgtgttcagctcttccctgtggtttcctttcttgtgtcctgggcattcagatttcatggcggttgtgctttttctgtctggagaaatagagccatgttcctgtgacttgacttcctgactgacttccagttcatttaaggataaagttgtgaacagtttaggttttaaagggctctctgaaagcactcctagtaacattgtggttttgtttcttcactctgctcattgaaacatttgctttttctttcttcaaaccagcataatgactttagttgtaaaagccttgatttttgcagtttgtgctgtcttgtgtaattttgccaacttgtgcaaaacaggctttgttttaaacatcagctaaagaagccaaattctcattttgaagtgtcttgttttcccggggctgtttgttcacgtggacagtgctggactccagttggtggaatgtgtccagcttgggcagcagagctcctcagtttctcaatcccttcaccttagcagtcccgtgagagtcttctgtgcttgtctccatcatgtccattatgaaggcagagaggtctggtgtaccctctcaatcttcagccaggttggagtatgctgctcagtggctgggaacttcccatggatagctcttctggaacactgcagcaccagttacgttacaattttcccttctcaagttcttagtaagcgtgcgctttgtctttggttcaagcacatggtgctcggagaaggactggcatatttcctcagggattggtatcacagttaggtggatatgtacatgtctgctttggtgttggttctgtggaatcttactaggtggtttttaagttaattaataggggctggggagatgcctcagccgtaggaacactgactgctcttccagagaactgaggcttgattcctagaacccactttgatagcttacaaccagttccaggggatccagtaccctcttctggcctctgcaggcactgcaaaaatgtggtgcataggaatgtatacaggcaaaagacacagacacacaaataaacagtaagtaaacagtagacaaaaaatcaaataggaaatgtaagtctcatgtgccctgggggttcagccaaaatgtttgctgtgtcccaagaaaggtggagctatgaagcccactcgcagtggaaccaagtgggtccatgtcagctgtgccctgtggatccctgaggtaagcccgggtcttaagagcatcttagtggagatggtcctggttttcaggtggaattgggcaggtgggtgggagtgattcataggctgcagtagagctgccggatccacactgctgttgagcactgccacctcatcatcatgtgtgggtctgtagatgggctatctacaagcagaaatggcttgggctgcagattggtcaggtccacacatcaccccaccagtacttttttgggaaccctaacatggttgacaccactcacagagccaggcctggcaccttcatgactatgtcctgagggtggccatgctactgtccctgccagtctgtgtgtggcaatctacatgtacagtaccacagtgctctgggccacatgtctgtgagttttatttaaattcttactcagcctcagccttgttaatttcaggtctggtctaatttatttccagtcccagaccttaactaatttaatttgcatggcttgtgatgagaatgtcatttgtgattcaaattccagtattttggtatgtgatttggtattttgtttttttgtttttttttccccctccagaggaaaactgtgtaggtgtgatttacattgaggtttcactggtttgatattaaccagtttgcagttcagtgatccaggctgaacaataccatatttgtcttggtagatttttacttttaatatagtttcatgttctgatggactaagattaagtttatctgtttgctcacttcatgatttaaatatatttatgatggggttttttagtcttgacaaattcttgtcaatctagatatttggtacactgttttaattaagacaggtgtatttgccattagacactaaaaagaagtgtaaaagcctagatgtgtttttatagagtggcatgctgagccatatgaggttgagctgtgggctctcctgctgatagtccagagctgggccctcaggtctgtgttaggattctgatgaactctgttatactcatcttgctgttttggatctctaggtaagcattggcagccctgagaagatggagcctatcacgaaggtgtctcacatccccagcagtcggtgggcactcgtgtgcagtctctgcaatgagaagtttggggcttccatacaggtaacagctcagtaagagtggctttgttttcctgcactgtgtggtagggagcaggattcagggagggacggactttgcacatcatcggttggttaggagaggagagcttttctggacatccatctgggtgtggaggcagttcagtttgctggccctatgcctgtgtccatttctttccacaagtagacattcctggtaaagacactcctaggctgtggcactcaagagttgcctaccttcctacttgtagtcatattacaccacacagacccagaagtcctctgactgcctcctggggatgccagtagctgacgtgttaagacctatgtaaacagacctatgtaagacctatgtaaaaagacctatgctttttacactgagaaacgagtcctggagcactggctgggaaaagggcacgagcaagctgctgccctgggtgatctttgtatgagtcttacctgatctgagtatggtctggactcctgagagccagcctgcatgtaaaaatgctgattgcattggcttgttcaggtacaggtaagtgcagaaagtcatgaggtcggtgggtggaattcaggagaaagtggtgttgatgggctgtctgtgtcttcatattgcctgaaactgagtaatcgatttctgggactcattgataactactagtcagttatgatttgaggcctggaatgctgtgtgtggctgaggttttaaaggtgaagtctatcttcctttggaatggacccatcattatgtatcagatattctctctgtctcttcctctgtctgtctctctctgtctctctgttgaaatctgagagaccaatgcagggaatgcaacacggacattcatgaacttgacaagtgtggttctgactttaaacacattacttcatttggcagaatatgttatattttggctgatcagtggttctttgagtaaggtacccgatataatataataatgggtggtattatattcttttcctgtttttaaacaataaagtgtttttatttttgactactactatttccaccgatattcaggcatccaaaaacactaaaaggatatcagggctagcacagggaacctgagaggatttggtttcaggaccttaaaagttgtaattttttttttttttttttgtacataagtagaatttgttgaaaactaaaatgataaatgcctctgcctgaggtttgggttgggcagaattagaggagaggtcaagaatgattttagtgtttgcacatgtgtgcagcacacacgcatgcatgcacgcacacacacacaccacacccacacatgctttgcttgttgcagatcagggaaaatggctgtcctcatgtctgtgttagctgctcttttgagtataccaaccctgttccttaattggcattccatcggaggcagatgggagccttgtctttcaaggagaagcgatataatgacttttctattgccattgacctctttttcccagagtattaatttgaagaaggggccaaggaaggctgatgacttttcatatcttcacaaactagatttttattaaaagaatccctctccaaaatgtctgcagctgggaagactctggtttatgtttctgtaacatctgtttgctgagtcaacctgaataggaaatcccagaggaaggccatttggcgtcttttcaaagtcttgtataaatattctgctgcagctcatttctctttaaggttagaatgcctgggttaagtgtagtttaagccaaacgcagattgtgtctcagtcatctgttcccacttttacttcccacttggcttcatgctgctggggagaagtagtgccttttcatgatagtggccaggtgtgtctgtgtgtgttctgccaccaaagctgatttcacacgtttcttgtaattgaggttagttataaaggtagagattaatcttagtgcatatgttttaggtggttggaattgggggtggtgaaggggctggatttttttagtaaaggattaaattgtggctggcactgagttgtatctcaaatactgaaacgatgagggggaatccagctccagtctctctcaactctctgtggttatgtgatgcagggtctgttgaatgagtttaattaagcttttcagctgtcctggagcacaagatccttggttgtctgtgcagccctggcatgccccagggatcccttggcctcacacaataagttgcttttaagggactggcttcagcctctgagaggtacctctttctagggatttgctcagtgagatcagacgggagaagttaatcactttgctcctgctggccagaggcttgtgtctggatcaaagacactaaattgtagccttgtgcaggcggggagggagcagggtgttcagtgcatcttgatgaggcctggccgccgtgctgacttccctggggcccacaggaagggagcctctgatgcaatggtgattctacactagcagggaggcctttctccatcctcccttattctgccttcctctggtgtgatcctggatgctgcttccaggaagtctgcttgtatttacctgcctgagttgggaccttttccagctaggggttgtactgaggattcagtcttttttaaaacctaccaggaatgtgtatgctgaggagattgctgttcacattttttataaaactatgtgagcacaaatctttgagaaactagattaatgcctcagagtatactctgtacatggagtgcatgtcttgagggttgtgccatcctcatctacagggccagttagttgtatgctggcccccccaccccccagattgtagtgccgtgactgtttgaagcaagctatagtttgggctgtttgcattgttccccgatatctctgaccttcccttcccttttcatccttgtctagctttcctgtctcagtgagtgtgcctttgtcgtcatgtggggtggccagcactagggactctggttgctactgctccataatggtctccgtgtgttctttgcagtgctctgtgaagaactgccggacagccttccacgtgacctgtgcttttgaccgtggcctagagatgaagaccattttggcagagaatgatgaagtcaagttcaagtcctactgcccaaagcacagctcacacaggaaacccgaggagagcctgggtgagggggctgcacaggagaatggggcccccaagtgttctcctgggagccctctggagccctttgccagtttggagcagaatagagaagaggcccaccgggtgagtgttcgcaagcagaagctacagcagctggaggatgagttctacaccttcgtcaacctgctggatgtggccagggccttgcgactgcctgaggaagtagtggatttcctgtaccagtactggaagttgaagaggaaggtcaacttcaataagcccctcatcaccccaaagaaagatgaagaggacaatctagccaagcgggagcaggatgtcttgtttaggaggctgcagctgttcacgcacctgcggcaggacctggagagggtaatgattgacactgacaccttataatgacttagagaagaagatgtaaagaggcgagcacttgcccagagcaagagatgatagccagtcgttactctcagattcttgtacacactacagcatggggttgtgttggttaaatatatttatgggctggtaaattcactgcagtgtgcaagactgctagtgtgggagctgctttgtgattatttttctttacatactttcccattaatctttactgttctgcaagatcagatggggcatacctccatcccctgctcgctcccatcattgtaaagctggagggaattgagcaccaggaacacaaccaaagggttgactcagcattgtttacagtctgattttgagaactgggatgtatctgactaatgggggagagggcagcagtaggggaatttcttgttcaacctggggagacatttcctaggggctgatggaggacccatcagacagagctaagcactgcctcccaatggcccatctttgcttctaggctaattcacgggcattcccagctctgttgccgagcagagcaggctatgggtgctgataatgtgtgcatgaatttagacacacacctgctacagaagacacttggtagtgaggtgctaagtcatcacagaggttgtgtacatgcagtgtgtgtgcttgtgtgtgctcgggtatccctgtcttttgtgtgtgtgtgtgtgtgtgtgtgtgtgtgtgtgtgtgtgattcctggtgcacaggggcattgggtctgtctggaatccttagcagtctcagtacactacatacatatacacagacatgtgtttatcatactactgggttgctgatgaagtggctggctgcctggagcctcagctgctggcacttccctcagctgtttgctgcttggtgcctcccccactctcctttacctctggagtcctagtctgaacctctctcttcctgctgcaggaataattaggagtggactgtcctccccagggtctccagctcccttaggtagttttgactgaggcttactaattggggatgtgtcttcagcacctcttacacctactcccctgactgctagctacctattaaattcattagtgtggcagagatgggatgcaagtttctggcctgaagcagcctgtgctgagaggcacccaagtggcctgcaacagttaatgcatatctccctcaagcccctcacttattagagaggagtgattcatcacctgctcagcaagagaatctgactcgaaaatgatttgaaatgagagtgtaggcagggcagagattgactgcagatgtgcttagccaaaaggatcagttctcacagagacctgtaccaccttgttagcaatggggtagtcatgaaagtagttttaagtgctcattagaggcccttttagtacacaccttctaatgctggctttttgtgatgtccctttctaaaccatgttaggattctgggtaaggtggctggtgtcaggctaagggggaggcaggagcaggttggtgaggctctcatactcccccctggtggttagtgcaaagaaccacgtgcatttgaggtatgttactgagaaagggattcagggtaaatgggtattatggtcagaagctaccatcctaacccaacaactgctgtaactggggtgcatggagtcagatagtccttgggagcaaaggacgagaagtctcatgttttgactgtgtttgtttcacaatcaccacagaataaaagtgtagaaaatgcttgtggtgtactaactctttttctgtatttaagataactgagattaacatacacgtataattaaattctgaactttttggagtcgtcattttgcttttaagtagaataatgcctatgatgtataagggaataaatcaggatttgtgcacgaatgcgtgtatgtgtgtgtgggtggcattacttaacatttattattaaaaagtctaaagttttaatgaattcagtgtcagtttaaaagggtttatttataatgaaaagttgtgttttcctcatctgctatgagtgctgtctgaaaacgctgtggtctatgccaggccctagagagttgtataatgctttacaattataaacaaatgtatcaggccaaaggctcatcagggcaggcatgacaaaagaaaaaaaatccaaagttacaataacttgttttctcagtatgttagtgatctgcgtatttatgcaatatcagctacacaataggcactcaagaaccagttaacataggtgactggaatcaaggtatgtggtcattcctgaactaacaagtgagtagcatttattagaaatgcaggtgactcagattatgttaattgctctttctggcaaataaacacctcgggggggccttgcacacctgggtaccaattctggaccagaaagttagatggatatcaggaggcaataaaaagagaagatggtaatgtgaggagtatcactccaagttcccaaagctgccacctcactcttacaggattcctgaccatctaattgggagatttattgcatctgcttagaaagatgtactaagtgttagctcaaaaactgagtactagttcggataaagacatcctccctctgcactctgtagttgtattggaaaggcgccaagttctgagggacagtcctatgcatttgtcacttagtggaatagaactttttgaaaacccacttgagaccacagttgtcccctgaacaaaatgtgtataaggcattgtgtgtcgagcattgcttagagttaagaaaacccactgcaactattcttagctgttaggccggtaggtctctcaggatacagtccctgatgtaacagtaacattctggaaacctaaaagtgcaaactggaatcaggtatcatcagcattgtttctgtttgtgaatttcctttaagaggaaagtatgacttggatttagcctggtgttgggacatgaggtgatgagtttggcttcctgatgctggaagctgagggaatgtgaattggggaagtttggctgagtgatatcagtcaagttctctgggcaaaggccatgaggccatgactagattcctgccaagaatgctttttttggggggggtcgtctactttggggcgctcaactctacaatggctagccagccagagctggatcaattaggccttactgatcccagctggaaaacatggcctttttgctttgtggatttatttagaaagaagctccttatctgaggtcactggaaataaaggagtttttctgacttagaggccatggtaaatttcctggcatacagccaccaaagttgagatatggcttccctactttaatttttgtgaattaagtttgagatgtatctgcttgtccatctgagttgaatatgagcatgaactagaatgcccatttcatgtttgcaaaaatcagattcatctttatgtaaaagctgacttatgtggactgccctaagttttgaatttgagatgaggatttaggtttgattctttgttttcgaacttccacccataatctcatctgggtgggatactacttatcaaagagagggaatatcctgttagtcattaaattttctctaaagaactcctacttctctgcctgggattatggctcttagagttaacttagacaagaagagtaatttcctttttaatgttttaatcagcctattttttaacagtattaatgtaagtgattaatgtagaaatagagacaggaagaccctgatagtgagtcagtcagggtcagcaaagtctgatagtgtttaccttcctgtcctgttctcctgtaaactgctttgaacgcagctgggatttagagagccttggtggtggggagctctctgcacaagtcagtgtgcaaaacggtatggcttgtgccagagaagcagctagtgaactttgaatttgcagtatggcacaaagagactgctcaaaagaaggatgtatttttagggtgccattaatgatagttgagcatgtggtcattttccacttctgccacagccactgaggttgttgaggttttatgggcatcttcttgaagaaaggctcaacttttcagtggtgggctgcagctgacattttatcttcaggcccatgcagtctagtcatgtttttttgagacagggttactctgtatagccctggctggtctggcactagctctgtacaccaggctggaactgaactcagagatccacctgcctctgcctcaaatgctgcagattaaaggcatgcgccaccaccaggccaatctagtcacttttaccaggagactttaggatcaagggatcagtcgggtttagtgagttaattcttttgttttgatgacaggtagctttaagatagattactgaccacaaactagtggatgtgtacatgatctgtctgagtggggaatctcagcacttggtctttcagttacaaatgaactagaatgaggttagtagcaattttaaactgatgatccatggattcagattgactggggatgcaggaacagttcccaggcatttgcatacctctctggagtacactgcactgctggtctggttttgcaaagttgtactcagtagaccaagaagctcatcagatcttccagagaaccttgtgcaagggattcctcttatgcctttggcctggaagatgcttgataaaagcatgcagggaggttgcttctgaacttgctagatccattggcagtaagattgctgggatgacactgttggatggtaagcagagcttacgcacaaggcagtaagtcctgagtaaacagtagaggtctctatactgcagactggtagggaggagtgggactctattctctgctgctcctcctctgtcactctgtggctgctgcagacactgaggggataaacaagcacaatctttctagtggtagggtaaaatgcttaaaacacgtttggatttcacatgtctgtcaaggcccgagcagggccagtatgtctcaggtaaaggaaaactgaatttactgaagtatcattactgtattgctcacttagaatctttattctctacattctaggttcggaacctcacttatatggtgacccgcagggaaaagattaaacgatctgtgtgcaaagtccaggaacagattttcagtctttacactaagctcttggagcaagaaagagtttcaggtatgcattaagccatagaagggcaaaatgtagggcaggggtttgtagccttaacactgctattgagggaaaacagttgctctttcatctgtcctgtataaagtttaaatagtacagctgttcatatttaaagaccacctttaaacattgaaggcatcctgctgactaaatagaagcaagttgtaaaccttacttctctaattgccttatgtgaagtgggaatgctagctcttgtaactatcaggaaatcaaaatgaaagtgagagtatattgcagtgctcttgataaacatggggtagctacaaaggtatgcattctctagcctttggatcgacctgacatgtaaataaatggtaagagtacttactcaccaaataaactcattttataacacttagggtggacttctgaagctatagatggaattctgagtgtgggacatttatttagtgtcttctatttacattgttctggccagtcaaaatgtgggatgtatgcttcttcaactggagagtgtgtcagttacttggagaccatgtgtaatgctgggcaagtgtttcactctgggattcatttgctctttaattagtttggtgtagaaccatgacctctaaagtgtgctaaaagcacacttttagcaccagtgttctatgaggacaatccaagaagtagataatgtaagagtttcatggaggaagtctatcctgggaatttgttcaacacagttcaacaccagtccctgagtcagggactggtgattttgggctggccttcagtggaagaggatgagttgctccaccttggactgccctttaaaataaaataaaataacaactttcttgacacttggttgtgtgctgagtcatagtcgactcactcttccctcactgatttttgtggtcttttctctagataattatggttcgaaactgttgaaatccaaagtctggcttagaattatatacatgtgactagatacaacttgactagttgaacacacaaaaatgactgaggggaattttcaatattcttagtaacgttaacttagatgtgttcttgctaagattaagtattttccaaagggatcaactgtattgcattgtctggaccttgaactttgattgcaaaactttgaacgtaagtttttcatagtacagcttcataggtaaagcagtgcaggttaggtcctttaaggttaccctccatctcttcattcttccattggaagatgatgttgcctgggatggttaatgtagtgtaccctgcagactcatgctagctgaagcttttggtacttgctgtgggatcagtaattgattacccatgaaggatgatctttcttgtagcttgaaagcagtcgtggctgaggtttatacttggctgagtgaataatactcttttcacaaagttaggatgtgttttggattatgacactgtaatgtagattcatccagaattctctgtactgctgagcatgatggttcatgcctgtgatctaagcattcttggggctgaggtaggaagaatgccaaaatttcaaagtcagtctggatgacattgtgagttctaggtcagcccatgctacataatgagaccgtgtttaaagaaaacaacaaaaacagaagtacagaaaagagaaacaaattttatcttcccttcattttgagttaagtggcaagtggtcagttgaaacgacttactcttctgtgggatggccatagcaaatgctgctgaagccttctagggtggcttttctttgtaatttctagactctgatgcttaaagtatcctgccttgtaagacagattcaagggcaatgaccacgactttacatgtgttctttagaattcatgtctcaaattgttgtgattctgggaacaagtagggagagcatcttcagtggaaatggtgtttatgggaggcctatcttagatacttttgagagacataggctccaagtccattagatagaaattacagttcagacaacattgtaccctctttacctttctgtttcctgctagggtatttcggtaaaacaaacagaaaacccatctcacacgtggctatcataaaaatactcactccagtgatggttttttttttactttgagaaagcaggcattttcaagccaacagcttgcctcagctgtgttgctatgcctacatctgatggataataaggtcttgtgagggctcccgtgatacactggaactgaaccttattctcttcaataggagacacaaaatgtgagaattgcctttttgtagctggtcttgatactcttgaagaatcatggtccttatgaattcatcagtagttttcagaccagggttaatgagtaggaggatatgagataaatttagtggatcatgactaacatacagaacaactatgaaatagactacaaagtctcaggctggagagatggctcagtcagtggtcaagagtacttggctgctctagcattccagaggatctgggtttgatgcccagtactcacatggtagctcccaactgtctattataataaactccagttctagctccagatctgacacctccttctggctttcataagcactgtacccatgtagtacatagacatacatgcaggcaaaacacccatacacataaaatagaaataaaacataatttaaaaaataggaagtgtcagtttctgttgaagagatgagaattgaaatttcataaaatacaaccttttataagttaagctatgagacttaagttctatgatttacataaaagactaacttatctttaacttggacaacaagttgaacccaaatagattttgcatacaatgaatgaactttttttcatattacatgtccagaattattgtgaatacctacctttattcagtttatacatttacatatatttgttctcaatggccctttggagaaaaacttgaaagctctggctagtctcagaaagggaagtggtggatggtgactggtagatggtacaattgctgctatgtagccaggtggaggaagtggcagctcttgggaagattctgaatggattctccttttaaagtcatatcctctttgaatttcgtttgtccttgaacagtttcaggaaaatttgtattttagtgggtttgggaaaaaaatgtagtatatggactactacttagattgaaagcagcagattctaaatcaggtcatgtctttaaaaacattttttacaaagtgctggtgactcttgggtggcaagtttgtgaaatgatgcttcaggtcaagaactttattcttttggatttgcttatttaattttcccttgtttttctgtttgtaggtgtgccttcttcctgctcctcctcactggagaacatgcttttgttcaatagtccttctgtgggtcccaatgctcctaagatagaggacttgaagtggcattctgcattcttcaggaaacaaatgggtagtacttccttggttcattcgatgaaaaagtcccataagcgagatccattgcagaatagtcctgggagtgaggggaagaccttgctaaagcagccagctctgtgtggtagaagggaggggctgggggtcccagaaagctttctgagctttgaaaagacttttacagaagcacgcctcatatcatcagcacaacagaaaaacggtgtggtgacaccagaccatgggaaaagaagagacaatcgttttcattgtgatctcattaaaggagacttaaaggacaaatcttttaaacagagtcacaagcctctcaggtctacagacacatcccagaggcatctggacaacacaagagctgccacctcccctggaatagggcagtcagcacctggcatgaggaaggagattgtgtccaagtgcaatggctccctagtcaaagtgcctacaacacctgccagcccagtgaaaagctggggaggatttcggattccaaagaaaggggaacggcagcagcaaggagaagccctggagggggcctgccaccagcactcagactgtccccacttgggtttaggccgagttccaggcaaggaaagggcaaagaacaggttaagatccgacagtgagaacgatgggtatgtccctgatgcggaaatgagtgactcggagagtgaagcatcagagaagaaatgtatccatgccagcagcaccatcagcaggaggacagacatcatcaggagaagcatattagcctcttgatgaaacagacgtggaaagcacgtggcttgttgctggccatgctgaggagagctctgacatgggggcaagcaaaacccattatttctgagcgacatatttttccttgcaattcagattgaatttttttccagagtcatttataaatcatttttgtgagaagtttgtgttatttgcaacttgttgaggaaacagaagagtagattgtaaccacaagacactaagattagaacctgaactaaacactaaaaatgaagtaacattagagagggtcaggtttgaaaggcaccttgcattactgccctccacgtttttttttccaaagcacaaactcttggattgagtacagaatcagatagaattctgtgttatgaataaattctatttatagaagccttcactactatttatagcccacaaagcttattttctaggaatggtaaatgctgacagcattttggctcccaggctgtgggtgtgagtagctgggactcagaagcttcagcaacactgggatcttgcacatgtggcatccaggggaagagtttacacaacaggcattgatggaaggctggagggacagagctgagctgctgaagtgagacttagggcctgtgccccagagtgggctgtggacatagagtgggtggagaggacgcttatgagaaagttctgtgagaaagggcagccaagacccaagtgttactagtcctcttgactttcctcatacctaactgctggtccttggacccaattcggatttccctggctactgccagtacttgaccacctggcttccaataatacaatgactattcaagttcaagtgatgaacttcagactctggtgactctcactccccagagtcgaccactagtgcatatttggggaatccaggcttccaccatgaatggattccttaagcaaaaaggaaaaaaagaaaaaaaaaaaaaaagaaaaaaaaaaggtaaaacaggttatattttaaaacaatagaaaggcaatatgttgggtcaagttcttatattgaccaaggctatataggaaagaagtcagtccttgaataggtttcctggagttggagttctaaactctgatttgtaacttggactttcgaattgcaaatggcaataactagtaaattatcagcaataataaatttagcattgaatttgagtacaatgttctgtttttgcactcacgtagtgcgtatgtattcagacaagtggatagtgttaaagtcctgttattttctttggcattcagtgtagttgtgaatcaaatttaagacaaggaaatagcaatgagatttagaattaagggcatttggaataagccccatttcccctaaattacccttagtttgttaatattaatgttcagattcctgattcatttatacatctgtttccatgtggcagggacattctgatatttaatgagcaatgctttgagtttgtagaagctttcaagtcttccagatgatcgtaaacaacagaaaaggcttattgaattccatcttgctatgcaagttttatcagatgatcaaatgacagatctgatgcatcccattgtatgtatattttcaaaccaagtcttaacttctcaagtacattgtagtagctaattcaggggaggggaaaggatgacccaggttttagattgactatttttgagctgtggagctccttttgagactgctgtccagatcagcttgttgctaccggtatttgaaggttcttaggagtcccaagttgtacttccgcttgtagactaatttaaaaattagatgttttgcatatgagcaaaaaccttttgctggatccaggaaaaggttggactctatctagttatctttggattgcagcaacagcactgggtgagaatagaatttatagaggaataatttgtgaagccatagaaagaaaacctaaattaatctagtgagtgtatagcctctcaccagtttaaggggcaccagatccatttgcactattaggaatgctagttttgtgcaaaaaaatgccttacctgttttccccccatatttaggttgaaaagctttcaaatgttccaagtttgctgaaccaaaaaacaaaacaaaataaaaaaaaataaaaaaattcccctataaaaacaaaacaaaaaataaaagcccactttttattactgctttgaagttcaaatggtatagagcacggtttctgacagtgtaacgacagctttgtaagttagtttcatgtcatgctgggaactctgtatgaggcggccatacacagcgacagcctacctacccacttgcattttattagtatggagcttttttgtttgtttgttcttttgaatcttccttgtgcatcctgaccaagaaatatctttgattatgatcaatgtattatgtcaaaatgtaggctagttaaacttttgtaaagttgcctggaatgtcatttgttaggttataaacacaaaatttaaatgaagggttttatgtgttgtgtacaaatcttaattattttaaaatggacaaacttgtcattacatttgtaaccttgtacagaggatttttcactatgtgcctagcttggtgtccattcagctaaaattgaaaaaaaaaaaggtgcatgaagagttaaaatcagaacttaaacaaagtatatgtagagatgactattttatattacatggcccaatcctgtatttatttctacccccctttttgaaagtatttataaaactagttgaagacagctgtatttttttgttgaactatttagtagaatttgtgcctttttgtctgtatgtgaataaatgctgtacattttgcaatacattttaagtttctgttgtgttaatctgcttttggttaggggtccttctgtgggtttgttgtctcactgttatatggagaatgagaactgtaggggacacacctatacagaggacatggaatcactgggttggtttctagacactgtcactaatagttgcccagtgtgggtccatttgtctccacctgccaccttgacaggatattatttggatctgaacacaattattgaagcaacacagactttagggtttaaaggctcagctgtggtttactgttcacataaccatagctaagtcattaagcctcatgagcctgagttttctcagaggcttatgcctcctacctcaacttccacagcaaggtgacatgggcctgttatcctgtaattttggaggttaaggaagaagaatcaataggtagttcctcaaacatcttcaaaaacaacacctctaaaaacataattgggtgtacctctgagagagaactcttgtccagcatgtgcaagaccctgctttccatctctactgctgtaaagaacaatgttttggtgttttactagagttgcaaagcatgtgctaggcatcgaaccatagtaagccatatcttatcagcattaggatgctcaaggacttgctatgactcggtgagtctgcccaggctgacgttattcctgaagattgtatttatgaattatgaagtacttaacatttttcagagtgatttcattagatccctttcagcagagaacaatgtaacagtaggtcaaataagaggaactgacctacattccacaaaaaagatgccgaagatcacagcattgggacttgacaaaactgagcctcttaatttttagttttgaatatttgctgtggaaacattcttacacaatcagtcatatgcacctttgtgttggaagcagcaagcctgatatagagtacacatccccatgtagattatgattagcagtgatagcatgtcattaccactctactcaaatttataatttgcaaagcttttctaacatgaatagccaatacttggctaaatccttgtttacttctccttgtcctccttagtgactatttacttccatgttgcttgctctaagactccagagagaaataactgtgattcttcctataaggtcttaaagttgaataatcacaatagctccctagggaaattaagtccccaggagcccaaggaagagcccagtgttggcaattttgtaatctgtgacgggaaatgtggcaccagggatttgagttcatgtttccacccaaatcaaggagaaaatggttctgcctttgaaacattagccatctgcaacaagctgccattaattgcaacactgaaatctttcctccagtttctctttaatgctcagaactgcattagacattcagcctagtctatgctgtctctgaaaaaaattaaaagccactctaatctatcctgtgcattccttggtttctgctgctctccatgcagctgaattcttttctgagtgtactgctttcttaaggggtagtaattctcagattctactgatgcttaaggtttgggaattcagtgtttctcttgttttaggcagcagactctggaaaccctctgtgaatgctttcttcaatggcccgttgttcgtcaaggtctctaccattccaaccatttccgtttcttgtggttccatcacctcttcacggttcttcatttcttgctagattgtagcagtagcctagtcttgtttccttgactcaggctgtgctgaaatgaactgcttcccctaattagctgtaaccttgccaatgctatctccacagtaacaacttccaaatggcagattctgtcattctgtacagccttcaggggtctccagacttggtaattactgggcttatcaagtggcaagcactgttctctttttgccaatgaggaaactgaggctcaccatttgtggggggatctggaaaccactcccatctagtctgatatggtctccaggctctgctgctctcagtatgaaagtagttcacataaagcaattcacatgctctggaggacatacaggcctatatatgtgaactttacttcatcaaatcatttatagtaaaatcaacagtttcggctttgcacattatattaagagactttgagaatgaaatgacagaagtccagtctgtgagggactatgttcttccttttgccaggaagaattgaattactttagctatacaccttcatataacatacatacttacagcaaaacaaacgcatatataaagagaaaataatactgctattaggaatgcaaagaatagttctctacagtccaacaatattcaggagataaaaaaattatttaaaatcagtttctggtatgaagattgttttgacactttgaagtaatgcaaaaatctccaaatcaatattttttttttgtgtgtgtgatattaagcataacaaccctagccatttctataaatggatgagcagtgctgctggatgtggtggccaacgtctaatcccagcactaaggagctgaagctgaaaggctgtgagtttgaggcagtctcaaataaacaagcaaaaacaagtaatgccaagtcaagtagcaaagcaaagcaaaatgaatggcacttgttctagcacactgccagtctgttctgatagtctcttcatggcttggcttgtatttaatagaccttttatagtatatttaccaattgtggggtaattggttattttacctacttatctggctggtggttctaatttcagaattacttccaatgtaaaacaattttttcatgaagtacatctttccctctgttgtttctccccacagcatcctcaaaggcaaactttcctcttttcctccccaactgtggctctgctccagcttcagtgtttgaatcgttaagttctttttgttagaaaatttggattttccactacttgactgggagttaggttatggacacttgggttttctaggtttggaatattaccaagttagtgccactcaatagaaagacactcagacaagttttcaaggtattaatgaaaagctttagggtttgagtcagaaaaggcagaatatgacaccaagattcctgaagatggcaggtgaatgacacacatacagattgttggaagctccaggagagcagtcaccctgtgaggtagatgacaacagcaaaaccctgctttcagtagcagtgaaaggagggaaacttaggaaactggagagctttcagtgtgtattcaggagggctcaaatctgactgaggaatgctttcttcccagtgagtgatacaaaggatggggacttcttatggcagggctttcaggaaacccacactgcactttcaataacagaaaggggagggagggaaaggtttgcttacctcacactttacttgagcggtggcaagaggccattttaaaaaacagccctgctgagtgggctaggtagacactgaggcagaggcccctctgggagcccagacaagtgtcaatgggcctcttcgactcagcctgtggaatacagtcagcatggagaagacgtggcacctgtatctagatgagagatgacatacagaccttggacctgtgcctagtactttttccttcacttttgtcctttccttagttaatatctaatttaaatataatggaggtgcttgttgtggaatattagtttaagatgtgttaaaaaaaagatgtgttacatttgtttatgctgtggaatatttgtataatgatgaaaatatgtgctacattcttttatgttgcatttctttaactctgttaagctgtgttactttgcctgtgtaatctaataaagagctgaacagctaatagctaggctattggctaggaaagggaaatgggcggggttgccaggcagagagaataaatagaagcatgagaaggaggaggatcgagaaaaaggagaggaggaggacaccaggggtcagccatccagccacacagctagccacggagtaagagggaagaaagacatatagaataaagaaaggtaaaaagcccagaggcaaaatgtagaagaggagaaacggactaattaagttagaaaactggctagaattaagcccagctaaggttgggcatttataagtaagaataagtctccatgtatttatttgggagctgagtagcctgcccccaaatagtacaacaaaacaaaacaaaaaacaactgcatgtgctagctagtttttatgtcaacttgacacaagtttacagtcatctgagagtaaggaactctcagatgagttgagaaaatgcttccataagattgggctgtaggcaggcaagcctgtagggcacttccttaattagtgattgatgtggcagagcctaacccactgtgagtggtgccacccctaggcttgtggtcctggatgctagaagaaagcaggctgagccatgaagagcaagccagtaagcaacattccttcatggcctctgcatcagctcctgtctctaggatccttccctgacttttgatgatgttacgtggaactgtgagtacaacaaaccatttccaagttgattttggtcacggtgtttcatcacagcagtagtaatcttaactgcagcagtggaccagctttgttctgtctcatttgccctttgtttttggtaagcttttccaaaatacagctccagacacaggaggttggagttggggttttcctgcctcagcctcagtgcagagattgctttaaattatttcactgtgttttcctttcttttcctttccctctagctggagctgtcttatcttcactattttctcttttctctctggagctctagaattccagtcatgttttgctcatttccttgtcattcctacccacaggaaacaggtattttagtacaccatgtactaaatcctttacaccccctccaattattagattcaaacaatgattgtttttattggctatgctgtattttcatctattggttgtgacagtcctgtaattagtattctgctcctggagaacagctggtaatcaagcctggtatcccgagcatagatgagagtttaattattgaattatacccctagtcagtagtactacaactgagtctgatttgaacatcatggatacacaaatgaaagaatacaggtgacttgaaaaagcaaacaaaaacccaaccaaccacccagataacccaaatgccaagacagaaatgtaagaagaaatatgaaaaagtagggcagcatgacccctctgaaaattactaattccacagcaatgcattccaatgagagtgagttagatgaaatctcagagaatttgaaagaacctacttcaaaaatgttcaacaaaaccaaagatggcacaaataaacttctgaatcaatttaaagagaacaaaagcagttgaatgaaataagtcaatgcagaatacaaaagaggaatttactaaagagatacaaatattgaagaaaaatcaaatttaaaattcagaaataaaaacctcaacatattaaataaactcattgggaagtttcatcaataggttggtcaaatggaagacatactatgagggctttaagaaaaggtattaatacattctgagaataaaagatgaagtagttaaaatatgaacaggacactggatatcattgaaagacaaaatctattcaaatcatgggcacaggtaagtgtggtggtttaaacaagaaatgtcccccataggctcatgtatttaacacttggtgcccagctgccagcactgtttggggaggttatggaacctttaggaggtgcagccttattggaggaaggctgtcactggggacaggctttaggggctcatagccttgcttcacttcttacttaacactctctggttcttgtgtgcatgcagataaaatatgatcagccaggtgccataccatgccaaactatccccaccattatgaactctagccctctagaactgtacgctaaagtaatctttcttccttaagttgctcctggaattttattgcagcaacagaaaagtaagctaatgataagctggtaccagggaagtagagttttttgctctaaagaaccagtccaaggtgtttctttgagtaatgtgatggactttggactagagacctatatttttgatgaagaacatggacctgtgaaataaaaagagtggtaagtcacctagtcttggagagcatccagatgctgatgtgagttctatcccaggcaccaaggacatttataaaggctaccagggcaggaaaagtccttcaagatgaagtctcaatcctgaacatccatgcccaaatacaaaggcacccacatttgtaaaagaaacattactaaagctcaaaccacacataaaaccaaatacacttatagtaggagacttcaacatgcagctttcagcactagacaagaccaccagacagaaacttaacaaagaacaaaggatctaacagaagttatgacccaaatgggtttaacagatatctatagaacattccatccaaacacaaaagaatataccttcttctcagtgccacatggaaccttctctaaaattgaccacatagttggcaacaaagcaaacctccacagatacaaaagaattgaaataaccccctgttatcttatcagatcaccatgctttaaagctagaatttaacagcaatacaaattgcagaaaacctacaaactcatggaaattgaataacacccaattacaccattcctgggttgaggaagaaataaaaaaagaaaggcttcttagaatttaatgagaatgtagacacaacatacccaaacttatagggcactttgaaagcagtgctaagaggaaagttcatagcactaagtgctcatatgaagaaactggagaatagtcacatgagagaattgacagaaaaattgaaagatttagagcaaaaagaagcaaactcaccaccaaggagtagatgccaggaaataatcaaactgagggctgaaatcaataaagtagaaactaggaaaacattacaaaaaaatcaatgaaacaaagagttggttctttgagaagatcaacaagatagacaaaccactatccaaactaaccaaaaggcagagagagagagcatgctaattaacaaaatcagaaacaaaaagagggatattaacaacggacactgaggaaatccagagaatcatcaggtcatgctttgaaaacctgtactccataaatttagaaaatctaagggaaatggacagtttcctggatatatatcacctataaaaattaaaccaagaacagataagcagtttaaatcattcaataaccctgaatgaaatagaagcagtcatcaaaagccttccaaccaaaaaaaaagcccagggccagatggcttcactgcagaattctaccagaaattcaaacaagagctaatactagtattgcacaagttgttccacacaatagcagcagaagggatattgccaaactctttttatgaagccagaatcactttgatacccaagccacacaaatatacaactaaaaaagagaatgcagatgaatatccctcatgaacatcaatgcaaaaatactcaacaaaatattgtcgaatcgaatccaagaacacatcagaaaaatcattcactatgatcaagtaggcttcatccagggatgcaaggatggctcaacatatgaaaatccattaatgtaatccaccatattaacaaactgaaaaagaaaaaccacacgatcatctcactagatgcttaaaaagcctttgacaaaatccagcatcacttcatgataaagatcttggagagaacaggaataacaggaacatatctaaacatgataaaagcaatatacaccaaaccaacagccaacatcaaaataaatggacagaaactcaaagtgattcctctaaaatcaggaacaaggcaaggatgcccactctctccatatcttttcatattgtacttgaagttctagctagagcaataagacaacaaaaggagataaaagggatacaaattggaaaggaataagtcaaactttcacaagtcaaactttcaatttttgcagatgatatgatagtctacataagtgatcccaaaaaactctaccagggaactcctacaactgataaacacctttagcaaagtagcaggatacaaaattacctcaaaaaaatcagtagccctattttatgcagatgaaaaatgcaatgagaaacaaatcagagaaacatcacccttcacaatatccacaagcaacataaaatatcttggggtaaaactaaccaaaattgtgaaagacctgtatagtaagaactttgagtccttaaagaaagaaattaaagaagataacagaaaatggaaaggtctcccatgctcttggataggtagaatcaacatagtaaaaatggtaatcctgccaaaagcaatctacagattcaatgcaatccccatcaaaatcccaacagttcttcacagaccttgaaggaacaatactcaactttatatggaaaaacaaaaaacccaggatagccaaaacaactctgtacaataaaggatcttctggtggcatcaccatccctgacttcaagctctattatagagccatagttctgaaaacagcttggtattggcacaaaaatagacagatagaccaatggaattgaattgaaaatcctgatatcctgatatcaacccacacacctatgaacaacttatttttgacaaagatgctaaatctatacaatggaagaaagataccatcttcaacaaatggtgctggcacaactggatttggacatgatgaagattgcagatagatccatatctgtcaccatgcacaaaacttaagtgcaaatggatcaaagatgtcaacataaatccaggcacactgaatcttttagaagagaaagtgggagatacccttgaacaaatttgcacaggagatcgcttcctgaacattacaccagtagcccagacattgagatcttcaattaataaatgggaactcctgaaactgagaaggttctataaggcaaaggacatagtcagtaatgacagcccacagaatgggaaaagatcttcaccaattccatgccggacagagggctgatttccaaaatatacaatgaactcaaaaagctagccaccaaaacaccaaacaatgaaattaaaaagtggggtgcagaactaaatagagaattctcaacagaggaatctgaaatggctgaaaaactcttaagaaagtgctcaaaatccttggccatcagagaaatgcaactcaaaacaactctgagataccacctcacacctgtcagaatagctaaaatcaaaaataccaatgacaacctatgctggagaggttgtggagaagaaggaacactcctccattgctggtgggagtgtgaacttgtaagaccactttggaaatcagtatggcggttgctcagaaaaatgggaatcaatctacctcaagacccagccattcctcttccagccatttctctcttggatatatacccaaataatgcacgttcatacaataaggacatatgttcagccttgttcatagcagcattatttgtaatagccagaacctggaagcaacctagatgcccctcaactgaagaatggaaagagaaaatgtggtacatttatacaatggagtactactcagcagaaaaaagcaatggaatcttgaaattcgcaggcaaatggatggaactagaagaaaccatcctgagtgaggtaacccaatcacaaaaagacaaacatggtatgtactcactcatatatgatttttagacatagagcaaaggtttaccaacctataatcctctaccccaaggaaactagaaatcatgaatgactctaagggataaatggaccccaggaaggtaggggataaatgcatgaaacccaggaatgggaagcggcaggaactcctgagctaattgggagcatgagggtagggtagggggagctgccagaatgagagcagaagagggaggaggggaggaaatggaggagcagaaatattgagttgggggaagaatagaggagagcagaatgagagatacaatattagagggagccattataagtcccaggagagatctggcactagggaaacttccagagatctacaaggatgacacaaactgacaatccaggcaatggtggagaggataacctaaaagcccttcccctaaaatgacattgatgacttctctttatgccatcctagagccctcatccagtggctgaaggagtagaggcagacatccacagatacacactgaactgaactctggaacttgagagagagagagagagaaggctaccactgaatcaatgccagcacagatactacaacctgatagatgccatgctgcagagtgtaagggattctggttttaaacctagctgtgtcatctgcttgtgatatgactggcaaatattcaacctttaccatactttccattattgggaaggggatcatctccaccaagcagatgtgttggattatatgtgatgataaatgcaaatgcttactgttcatagatagcaataaatatatacctgtaatatgtatcaacatatttatcatagatccaggacaattctccaatgaattattttaggtgtaagtaaaactgtaattgttacttctctagtatttttttaccctctataatagtttatataacagtagagatgctagtctctattttcacagatccaagtgctaacagttttccttacacatcatactacattcttctggcacttttttcctttcaagaaaggacttggttaccatcaagtaaaaatactgaatgaaaatttccattatgccttttcaaaggtttcaataaacactaacagaatgaatcatggttactaggatgctacatggagttactaagaagactagcaattttcttgttgatcaggattagattagaaatgggaaacatgtctagtgtggcataaaagaacatttgcaagtcaaaaggcttggtaccttaggataaggtacagcaggaaaaaaaaaaaaaaaaaaaaacagattggaaacaaattgaacagccataattgaaagtctctgacttgttatcaataaggtaacagtgactggatgagataacaggggtcacagtgtgcatagtgaagtgcctgtagcaatgtggagttggggggatttttgcttttaacagtactggagtttgaaactaggttctcatgcacacaggtgagtgctctacaactgagcatacccacagtcttctgcaaagttttagggtaaattcttgggcttaaaggtggtagtactgtagcctggcagtggtgttgcttgcctttaatcccagtactcaggaggcaaagacaggcagatctctgtgagttcaaggccagcctggcctaccgagtgagttccagggcagccaggactattacacagagaaaccccgtcttgaaaaaacaaaacaaaacaaaaaaaaggtgatagtactgtaaaaaattactttcaagatcccttatgtatgtacatagttacttttcttcttcttcatatacatgataatattaatattaccacaaatgctatacaaatgatagtattggtattaccgcaaatgcttatgttgttatgatcggtaaaagaaactagtcagtacccttttgcctgtaaagccatacatatatgcacatggttagggaaactaaacacatttttatttatgtttagttttgtgtgggtgttttgcctgcatgtgtgtccatgtatatatatgcagtacccatgggaaccagaagagggcatcagatcttctaaaagtggagttacagatggttggtaactgccacataggtacttggaaccaaactttggtcctctggaggagcagccaatgctgcccttaactctgaaaccatctccttaactcccaaacaaatttatttttgataaagtttactacaaatttattatttttcttccccaaatactattttctttgttatttttgttttgagacagggctcatactatagcttaggctgactcagaattcagggtacaaccaggttggttttgcattcagagtcatccttctgcttcaatatcttgagtgctggaattacagatgtgagtcacagcacctagctaaaatttgttgctttgcttgtttgcttttaattttttgaggatttttctgcatgaatactgcttatattatttaaatcggttatgttttttaaaaaggatttatttttaaattatgtgtgtttccttggattattgtgtgcacatgaaggcaagtgcccatagaggctggaaaaaggagttggatctcctggaattggagttaatgtggttgtgagctgccctatctggattatgggaactgaacttgggtccttagaggaggagcaaatgctcataattgctgagccatctctccagaccctgaatttgctagtttttgaaaaaaaaagttcaaatgtgctatggccaaagaacagatttatataatatttaaataatattcatgatgattggtttgagagctgctctaataagacagtactgctaggaaatcatatctgtagaataaatgaatggctggattgctgctaatttcctctctgttaaggtacctggatttctcacaccagaggagaattaggagaatactgactgtcccaatttgcatatttgtacacaaagggaagaagtagtaatcacatctcctttctttctcaggcagacataaaagatgcatgaacaaataaaatgaactagctgtgttggcttcaattttagatttagataatttcttttctgttttccattcatttttcctgtttcctaaaacacagaaatgataatgtctttgtaaatgaagttaagattgaccaatacatgaaatgttaaaattccactagcattttcacattagaaattattaacaatttatgaggcaggagtgacatactctcactctatagtttatcctggtcttggagaatactcagatattcacagagagagctaagtggagaggttattgttagatgcaaagaggagtcctcagttcagctaataggccattctgcatgaccctgttcttgaaacctaagtttatggacagttatgctacactctcaatgagccaggaattcagcagggtgctaaggacatagtggtgaatgaaaatagatgttatcttatcttaagaccttctaaaagttaaaaaaaaagccagttaattactggtaagtgcaacaagagaaaaaaaaactcagtattaagaacattataacaagagagggttcacatagtcttaagttagagaactcttatctgaggaagtgatatttgaaatgggaagatttcatataaatgcaaaagtatatgcagactttgttgactggaggaaggatgatgtaccaacagaattaaagaaggacaccaagtttagagaagaagaacgagggaaagctgtgtgcgaagaggctgaacctactatcctatcatggtaggctctaaggcaaactcctacattctcggctccttgacaaagatttctgtgattatgtcagcttgttagcaccattcctaaactttgagggtgagtgcatatacactatatgcactaatatatatattaggggtatattcacattgcctccaactcatttggaaaatggttaaagccttctaactggttattcagatgtaaacccgtctggtataccagtatacagggagctcacaccagaaaaacagagtaagcatacagatctatgcagcgtttcaggattacaacaactcgaagctatgcagccttagaatttaagatctccatctgattagtaaactttgaagaaaaaagaaaagaataaaaacccctcctaaatgctaaaatattgtcaaggtctataactacataaaactatgttgttaaaaatgagtcattacaattatgcattcaaatacatgacaacatcattttacaaaatacataatttattatattagagttcatagtagagaatcttaagaactataaaaatgacttagaaataacaatgagatattaaatctccaaattttagaacctgaaatatcaaatcctagggtttttattaaacctcttttgaaaatatattctttcaagggaaaaaaaggggaattaaaattagacacattgatgaaggcagtgtgttcttctcagctggctttattctccactgaatctcaagtataagattatatatatatttttttacttacaggaagctgtcactgttctgttttccaataaccctcaaaacagaatggaaaatgcttatggaaaatgacacaagctttcaccattctctgcaggcttctccatgtcaatgcactttggtacaacagctttcccaactctacagttctgtcagtgaactatgattatgtttaaatattttccagattcatcatggaggctgcttttcttctctgcactgtaatcacactgagctgcaaacaaaacaaacaatcagtaagtagtttctctgtggagagtgttaagactaaaacaaagcagtgtgctatatcacaaccaatgaggtagtctgaatggaagggccttgaaagagggtgtgtgtgtgtgtgtgtgtgtgtgtgtgtgtgtgtgtgtatgtgtgcattttactcttgaagtgtctgaatcacagtacagaaatacatgccaaatataacagttcatagttcctatatttctttctttcttctttttttctgagacagggcttctctgtgtaacagccctagagaccaggctggcattgaactcacagagatccacctgcctctgccttccaagtgctgggattaaaggtgtgccccaacaacgctctacttgtttttttgaaacagagcttactatgaagttcagactagtcttgtatcttgtgatcctccagcatcagctttctgagtcccaaagctacaggcaaatgctaccacctccagctacttgcagttttgaagtatatctcttcatatattttctaaatgagtacccccaccttggtagttaaaaagtctgaatttcctttactgcttagatgatctgcctcagaaataactgcataataaatttcctttatttttcttaatatctgtaaacgtttccctatctgaacacaacttcattgttgagtatttgtatgacttttaatcttttaaaattagagggaaagtcaggtgtggtggcacatgcctttaatcccaacatttagaattgagaggctggctaggaggagctctgtgagtttgaggtcagcctggtcaacatagtgagttccaaagcagccagagctacacagagagaccctgtctcaaaactaaaacaaaacccaacaataataacaacaaaacatagctactaaatgacaacatgccatgccatcagtagttaagaatactctgatgataacagtacatatatacccaatgttagttaatagtatgtttgacttgatttgctttgttatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatccatcccaattgcctaaatgctcaatgaactgatctctatccattcctaaaaggagttattgctcctaatttagaagaaatggctcatttcatttatataatgtgtatactttgagacattactctttacttacactagaatttcactgatatatcacattttccaaattacttcccaatggctaagtttttatattgtattttggatttatttggttatatacaaatgtacattaaataaaggtaacttgtatctgaaatattttgcttctacctaaaacctaaagtaacaataaggtactttcaaatataaacacaagtacttaactttggacagaacattatgtccagtgcaatgctactagcacaaacttgtgcagtcagcgatgttctgtatctgctctgtccaaccttcctactagccacagttaccaaacacttgcaatctggctagtaggacctcaagttttcatttcatttaatttcagtaaaaaagttctctggctaccaaatactttactagagatggtagttctagatatgggtgtagacagaggatactgatgtttattttacatataaactttatatactctaatacttcaactgcagtattaaagacgctaattttatgcaggttaattgagtaaagatcaaactgtcagttctctgggaccttgtgaggaaccctgctgatttacttttcatatatgaaggctgtttatcagctctggataacgagggtgttccctacctgctgggatgctgaagcagctctctcttctgcctgacttagacgtctttgaagtctgtttgccttttcttgatgttccagaattaacttttcattcttttaaggggaaatataaaacaaattcaaatccaaatgtgatatgtaaatgtcttatggaatagccagtgaaaaacttggacatgattttaccacttgtaaaataaagataccatcatctctgtatttacattttccaagttaagagcatcatattacacaggtgattttacttcttcctaagtcagtggttttcaacctgtgggtcaagactccttggagggttggacgattctttcacaggggtcacataccagatatcctgcataccagatattacattatgattcataacagcagcaaaattacagttatgaagtagcaaagaaataattttatggttggggatcaccacaagatgaggaactgtattaaagggctgcattaggaaggttgaaaaccattgtcctaagttatttcttcccctcatatcatccaagactccatttgacaaattcaaaagcaaactgaatcacaaaaaaccccaagacttcctgagtttttggtctgttgactttttggtgcttgatcattgctttagaaccacagaagccaagcactgggccttataaccacagactcagcaaagggttggaatgaactctgtttttgctcctcaggacatctgcatcctgtggaagctattagggtcactagatattgctaggtattgaattctattcccccaaagatgctatagttctaatccctggtagctgtgaatgtgcccttactttacaaataatctttgcagatgattaagtttaggggattatattgagtcattctgcatggctggtgtcttcatgaaaatggcatatttggacacaaaaacagatacatacagggaaatgctgtgaagataaatcatgacccataagccaaggaatgctcagagctgcaagagctaggaggaaggtggtaagagtctcccaagaagccaacactatagacactttcttacttctggaaccatgaggacatagttttatgttatttatacagcctagtttgtagtaccataatataacaggaaccataatatgaataccaagtgatcagtacatactttatttcagcaagttaaaaacaatttgtcaactgaaaatatgttcttttcccacacttacctgcttgtcacaatgcaaaaaaaagagacacttttgtaaaacaaagttattttttgttttctggtatttaactggatccagagaatacaaggcaaaacaggaatggctaaaaccccccttttcaatgaagaactagatagttgtttatgtcctagcatcaaaggggttaaagtgaatgccattctgagtaacatatagcactgaaataaacagcaaagggttaaaatgagcttattataattgattgtgtccaaaagcaaaattaaatctttgaaaagatctatatcagctgtactaaccaaccaagttgtttgagtattaaatttaagttttaaattttaaaaggtacctcatctactagtgatctcattatctaccaataatcattttgatagctacaatcagactatatataatatatatctatccatatggttaccataatggttaagacaaagtacagactgggcaaatttgatttttttgtttccttttggtcaaatattgctaacactactgtactgaaaattgtgctttttacttacaatgtatttttccaagtagaaaatttaccaaggaacatttcaatatcaaatctttaactattttctaagtgttttacataaaaaatgccatgatgttcaagaatggtgatctcactatgtcccttgtagatgacaatacaagataggccatgaaattctaccatacatatctgaagttagtacataaatgaagaattagagctctaggaagccttaaacctagaaacgatttgattttataaagccataagaaatgaggaactctttctttgtatatggttctatggtagatctatcttaatattatttttgtatattctattagacaaaagtatttttgatgtgcttttttgtgatgaagtaaaacaaatgaagaggacttaggtacacaagacaatcttagagagtctcatgaaaaaggatcctaaagtatatagtctctaaaacactgcacaaattatactattaacaccaaataagaattctacttttaccatttacaaaagacaagtcactggttttcaaagcttttattcacattatattaagtgtggactttcaggggtgatttgtatgtggttatttccaagtagagaatttggatttggtgcatttaaaatgctaccgtgtgtttagaaagtacttccctgggggaaggggagtcattttcttacctcaactaccttttcatttgccatttccagctgagaaagtagctcttgtgtatgaaatttctgtcgattcagctcactcctattaaacaagaaggggcagggagaatatgagaactgattaaaacacaaaattaaaaaagaaaaagtttagaagtatatgcaaatataaaatatacacttgaaacttaagtttaaaacaggaataaaacttaagaataaaacattatgaaactaaatttttactagtagacatgtttatattctgaacaattttttttttccccgagacagggtttctctgtgtagctttggagcctatcctggtactcgctctggagaccaggctggccttgaattcacagagatctgcctgcctttgcctcccgagtgctgggatgaaaggcatgtgccaccaacacctggcttttgaacaaaagtttttaaatagcaaacaaatccattttatttttaataaaatgtggtggtttgaatgagaataccctccataagctcatgtttgaataactggttcccagctgtttggaagggattaggaagcatgaacttgttgaaggccatgtgtctgtcactggtgtttggctttgatgtttaaaaactcacactattcccagggtgctctctcataatgtcctacttgcagatcaagatacaagctctctgctattactgctgccatgttttcactctgttatcatgaactgtaactttctgaaaccatagcaaaaaagaaacacttcctttatacactgcctgggtcatggtgttttgtcacagcaataaaagagtaactaatgtataaaatatacatatattctagggtagttacactgtgaggatatttaagactactgaacccaggaaaatggttcagaaggtaaatgtaatgatgtatattttgttacaattaaaaagtataccacagacagacaggtttagtggcacacatctttagtcctagcactcaagaggcagaggcatgtggatcttagtgagtttgaggccagtcaggtctacatagcaaattccaggctagctggagctacattgtgataccatgtcttaaaacacacacacacacacacacacacacacacacacacacacacacacacacacacccacccacctacccaccatgggcttgaaagatagctcagcagctgttcttccataagacctgggttaagttcccagcatccacataaggcagctcacacctgcctgtaactccagttccaggggctgcaatgccctccttttgtctctgtgggtgtgggcaatgcatacacatggtggacatagagaaaggcaggcacaaatatatacaattaaaaattcaaaaaaattgtatcatgctgattgtggtgatagatgcatgtaatgctgaacattaaaggttaaggcacaagataaaaaatgtgaggccaacctaggcctacaaaaggaaaccttggcttagaaatagacaattaaagaaacaatcaggtcacaatttaaaaaaaaattcacaacttaccatattcaaccaaggttcatgtatagtgtctcatggcagaattcaaagcttgcaaattattaaatattcaaatgccattttgatgtagtaaattgtgttgtgtctatgcatgtctggtatctctttgtcactatttattatgcttcgtaagctgaagttatctgacgcacagaattgaggttgcctcctctcttcctcctttgagacaggctctcactatgcttcttggttggcttggaactcaaactaggctggcctcaaatgtagagatctgcttgctctatctcctgagtgctgggattaaggatgtgtgtcactctgtctggaatcatctttttaatttaaacacacaagcatgtaggggaagctgtagccacgcttacttaggggctggctacaggtgtgcctgactacgcttgcgagggtgtggtcagggtgacgtagagagggactttcaggggactgcgtttctctttcaggttcacatttgtacttgctggacagactgctgccacgccggctggctaggttgctctgttagtaaggcttttccctattaaatacccttgtatttctacctgactccgtatttgtaattttccactatatctggttgtcaggagcaggatattggaaacctacaccccatttgggacaggctgtgggttccaccgggcctgtggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgttcctggcggcaggtgagctgctcagaacagtctgcccagcttggagacagtttctagctgtctagaggtgagtaggcctaggcttcccctggtcactgctgcggtaaagttgcatgtctttcagtggttgcagccgcaaggccgtatactctctaagataagcacagccgcttttgtgacctctctccaccgctaccactatcctgccatcgactgctgccaaacgccatggactaaccgaacacctgtgccacccactggtcaaagatagttactgcatctggagtagaaatcaggtaaaattatggcagaatatttatcatttgctaaaattggtaatatttttgcttattatgtgaattcactgtttgagcttattacgtgaattcactgtttgaggaggatgttaatgtgccaattactggcctatatgccataatggcagttagcttgctggtacaaatagtcttactagccagaggactcaggaatagggataaggataacctcaccacctacttacaggaaataacagctttacgcagtgaggttttggaaaacagatttggtcagaccacaattgtgcaacaagtggaacagaaattgtatgataagcttggttctgtgtccaatacgctaaagacagagctgtctgttacccaagatgagatgcagcgtatttatgataaggtaaacacagagagatcctccatgtctgaggccttagaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagggctgacagattacataggtccatacggtcaattgctgaggactcaaaatcagcaaatcatgacctccattctaaactccaacacctagaaggcattttccatgccatccagatgcttcctaaggatgatcgtattaaagacctagagaaacatgtagatgagcagttagagcaatttacagattcactaacatgcttggaatcttttatgattaaggagattgaaacttttcaaaaggatatcattactaggcttaaagatcattgggatgcctcagaggcagaaccactccaatccaatgaacctactctacccaggtatcacgactattcttctaagattgttacttgtacaccattagtgtacccagctaccatggtagaaaagccagcttctaaaaaacacgctcacggaaggatggcttataaatggcaacctatacagctgaaggatcttaagaatactaaagaatcagttgtctgttatggtctccatagcccatacataaaacagctattacattcatgggcaacctttaacagggtgacacccacagattgggaacgattggtagcagctgtacttgagaattcatgccaaatccaatggacggcattattaagggaagaggccaagctccttgagcgtcagggcataaaggaaggttttgaagcccctctagataagcttcttggtcagggtattactatgaaccagaaccttgggtaggaagaggcttcccctggagaccatgaaggcaccaggaatctagatgtttcaactgtggtaaattgggacatactaagagaaactgtagacaaacgaattctaacaatgcctcataccgaaggccactgccttctggattgtgtagatgtggtaagggcagacactggaccaatgaatgtagatcgaccagggacatacaaggaaacccgttaaggtcgggaaaccccggggggacctcaagaaggcccccttttcaagaaaggtcgggtcattctcagtagcaatgggagacaatctctcacaggaccaatagataattctttgcctattgtgaaaaatgattctgctctagatggtagtttgaatagtgatgaagaatcaaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagttcaacagagtgttaactcgatggtctgcattggaccagaaggacagaaagggatactgaaaccatatatgacagatatagctataaatctctggggtcgtgatctcttacagcaatggaatactcagattaatattcctccaatgtcagatacaaattaggtacagtctttagatagtagaaaagatctggtaagaccctatggaaaacggttaccaaccatccatgctgtacagaaactaggtataaatgatggaccttcagaggagccaaaccagtttgggtaggacaatggcctatgacctctgagaagctagaggctttagaaaagttagtacaggaacaactagacgctggacatatagaggaattctaccagtccttggaattttttatcaaaaagaagtcaggtagccctgcgccccaaatctgctagcaccccactcttccattctgccactgaccgacccaggaactaggtgagtctctgcccactcctgactccagcccaaaacatcatacaccccgaccacccccacctgtgcctgcgggcttgggctagacacggtcaggcaggaggagctccctgcacaccgaatctgctagcaccccactcttccattccgccgaccgaccgaggaagtgaaggcaccaggaatctagatgtttcaactgtggtaaattgggacatactaagagaaactgtagacaaacgaattctaacaatgcctcataccgaaggccactgccttctggattgtgtagatgtggtaagggcagacactggaccaatgaatgtagatcgaccagggacatacaaggaaacccgttaaggtcgggaaaccccggggggacctcaagaaggcccccttttcaagaaaggtcgggtcattctcagtagcaatgggagacaatctctcacaggaccaatagatagttctttgcctattgtgaaaaatgatactgctctagatggtagtttgcatagtgatgaataatcaagtgtgaatgaacaaaatgagaaacacatattttggcaagcttctattaatgataaaaggcctcagttgaaagtgaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtagtggattagtatttttccctggtgcaagaagggactttgagagccctggacacatggggaagtgactaggaccagcactcgaagatttggtggactttgcagagcccccgttgaggtcccaaccctgcctggggagtggtgggtcgatggggtagggagtgggatgggggtgggggaggaaagttgggggtgaggggagggagagggagaagggacttaaaataagcttgttccctaactagaactaataaaataaaaaaataaaaataaaaaagaagtcaggtaaatggagaatgctgacagacctgagagccataaataaggtaattcaaccaatgggctctctgcaacctggaatgccattaccttccttaatacctaaaggatggcccatcatagtcatttgatctaaaagttttttcacaataccgttataggaaaatgatagagaaaaatttgcatttactgtatcaactcttaattcacagccagttatgagatatcagtggagagttttgccacaaggaatgctaaatagtcctactttgtgtcaacactttgtacagcaacctttgtaaataattggtaagaaattttcacaatctcttgtttatcattacatggatgacattcttttatcagattctaataaggaaactttggaacgtatgtttgaaatggtgaaggaagttctgcctcattggggattacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctcagaatttcataagaaacatcatgtaaatagcaagggtttgaaaaacgatttctccatcacttggcaacaagccaaggagatagtaagaaaccgtcctacttgttccttttataaccaagctccattgccagcaggttgtaatcctaagggtattcagagaaatgaggtttggcagatggatgtctttcactttgcagaatttggaaatttgaaatatgtacatcatactatagactcattctcagggtttcaatgggctactgctcttaactctgaaaaagctgattctgttattacacacctgctagaggtgatggcagttatgggtatacctgcacaaataaaaactgacaatgctccagcatatgtctctacaaaattggaacaatttttcaaatcaatttttcaaatattataacataaaacatgttaccggtatactacacaatcctacaggacaagcactggttgagaggtctaatagaacacttaaggagatgctcaacaaataagcttggaagactacccccccccaaacacaggttgcataatgctttattaacactaaactttcttaatgccaatgagaaaggacaaacagctgcagaaagacactggactacgaaaaaaactgctgaacttcaaagatgtactaacctctgaatggaaaccaggacatgtgttacgttggggtcggggttttgcattggtttctacaggagaagaaaaactttggacaccatcaaagttgatcaagattcgactggaaaaggatgatcaagattcgagtggaaaaggaaaaacctctcgacaaggtcaaatgacaggtattctactaaggtatatctcataaactaaatagaaatcccccaaaagaaagggaagtgttttgcttttatcttcacaggaaaattcatctccagaaggcaaaggacactgcataggtagatgcttaagaagaaaaggtagctataaccatcaaacaaaaggaacgtgccatatggtaaacttagagctgtctctcagagaactctatttttctttatttcctagtccctattcaattaaaccaatgatggatttagaagtggatttggcttttctcctctaaaatccaagcacattatttaactaaactttagagtttctgtacgttagtgtttctgtattgtatcaagaagccaattgatgtaatacagaataaaagaagaatttggggactgtctttgtcttttcttggctctttctttcaaggtgaacaccctgtcatactcgttgtgctcccatggttgccttttgcagtatgtgtatatacacaatcaaacatatctctgctaactatttatatttgagtcccacacagccaatgaagacctgcctgacagcaatccctggacaccctggaaagaaaatggacccacttccttgactgcattggatccaacttgctccatttctacagacactctggctagagtttcgggtactgacttcaatcaagttgaggagttcaagcaagatcttcaatcaagcaaatcccatctaacatggactggatacaattcattcaagacttttactatactaacattttcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttaattttggatactttacactgttaagttttaatcctcttttcgactaaaaggggaattgtaggggaagctgtagccatgcctacttaggggctggctacaagtgtgcctgaccacgcttgcgagggcgtggtcagggtgatgtagagtgggactttcaggggactgcgtttctctttcggtttcacttttgtacttgctggacagacggctgccatgccggctggctaggttgctctgtaagtaaggcttttccctattaaatacccttgtatttctacctaattttgtattggtaatttcccactatacaagcattatattgccctgggccaagataattcgtaagtatcaagctcagaatagatataatgtagtcatacaagaatgcaggggtctctgtgatctccatggccagtagagtgataataaatgggaggtaaaaggcagtttggtttatcatgactaaactttgggagtctgaccctgagtggtttattttaaacacacaacataaacacacgcacatgtatatgcatgtacacacacacacacacacacacacacacacacacacacacacacacacacacacgtttttcagacaaggtttctctgtgtgaccctggctgtcctggaactcgctctgtagaccaggttggtcgcaaaattaagacatctgcttgtctctgcctcccaagtgctgggattaaaggcatgtgccaacactgcctggctattttaagcatatttagacatagtacaatctggtgaaaacttttctggtgataactcaatcccatgtgcacagtaaagcatacatccatctcttgaacaaaataagctaaataaagactggacatgactacatcgaaattctttgtaaagtgtatgtgacacctttcaaaagataggttctacagataaactgagaaaaataagcttatgatgagggcctggggaatgtctgatgtgaactgataatgcaaaggtcaccaggagagaatgctcatgtgctctcaacagatattacatttcttctcttgaaggagtaaacctgtatgtaaacattctgggttctcctagtgctcatctgtgagcaaaaggacttccatgtctacacagaagtgaatcagaacaaatttcaaataaattttgtggcattaaaatagctaattcagtactagcgtttagcccttaactttatatttctaaaattaaacaacaaaatactcccctaaagagtgccagtttttacactttcaaatgagtatgtaaatagctttagaattcagtaagtccctagttgagggaataggtttttaaaaattatatgtgttataaatacataagctaggatagatccatgttaccaatagtcagctccaataatagtaacttgaccacttatcacaggctcatgtgggacaaagagtggcagtcatagtgctgccatccccaaacttgcattctgaaagaacactgctcaccccttcagtgatgtataagctcagcttctcaaggaggtgtctgaagtgttatcactgattttgtcactgacaaactcaaatgtttaatctttattttggtggtgacaacaggtagagaacactgtacttacagcatcgaatgcatcttaaaatctccaacacaagaaaaacaaaacaagagagaaaaatcaaagtgaccaaaggagtcagccttctaggccaaatataattcaaggcaaaaattatgcatattagtattgatgaaaaataaccagtataactgaggttaatatgaaacagtaacatttatagttagtcaatattcattttacagaaaacgagaaaactacccactgtataatttgacaactattcatttacttaagacaattatctgaatagacagtaataatttttcacaaaactaacaatcacaaagatacaagtaattaagtataaatattatttttttactaaattatttgtctttttaagtatttatctctgcatatcaagttctgtcatactccatttgatttcaagccacttcatatgtatataacctagcattcagcaaaaaatgaatgatgaagctaggcggtggtggcacatgcctttaatcccagcacttgacagccagaggcaggcagatttctgtgagttcgaggtcagcctggtcttcaaagccacagagaaaacaagtcttgaaaaaaaaaagataatgatgatagtggttataattctaccaaacacacaatgcttcccatctgccacgtagttcaagtacattcagaaatgaacttatttgagttgtcaagacaacatggtgaggtctaattttatatatgggaaaactgaaaataaggtttaaaattgggtagaatcacaaagctccttgtcaggtttcaaaaactttaatctttaattcaaaattagtacttttaatagacttatttgtggttctggagaattactccaagacctcaagaatgccaaatatgtgctttactgctagggtatgtctccatccactaagcacctctgaagttggtgctgttaatccatgccccacagtacaacatagcaggcaaacactaaatccatgttaaatatgagaggggggaaagagatagaggaagatgagtaggaggcagggggataagggggtaaagaaatggatgcatgaatatgaatgaatatgaatgggtgtatcaggacttttatatactttggaaacctaacaagttaaatccttatttctgacttcttcccttaaagttgtggaactaagcatgcctattactgaaaattttaaattgtcctacaaacctataactcatctacagaagtcaatttttcattactatctttgccctaattacctaggctaaaaatcttaaagccatctcctattccttactttgtcttaaatgcaacatccctttctcccctaaaaaagtcttcctttggagtgtcccctgcatctgtttttctctccctctgcactacaatcacaattcaacttcttcacatttaatcttaagatttattctaatgagcaacttcaactgaagaaatacacacttagcactaagcacggggcatatgaaagtactgtggcattgttccctcccacttaccacacatacctagcatatttcttgctgaacaccaccctaaatatttttcttacttgaatagtagccatcagtatctctgtgcttttgaactaaatatatatagtccatgttcttgagaatggctttcagaactctgaaatcttgttagttatctttccaattaaagtctgggttttgagtgtctcacaaacacacatttgtatcacctttagatccatgcttatgttccttctttttagatttgttttttcattaaggaatcacccattctttaagaccccacccttttctcacttttctgcttcttagtttattttaattcagatnnnnnnnnnnnnnnnnnnnnntagacacacacacacacacacacacacacacacacacacacacacacacacacacacaccttttccaagtaaaatgggaactttaaaaaaggaattattattagttttcaaaatatttaacatcatgttttacacagggaatcactatgaacttgctaattcatggatgtcttttttaaaatttatttttatttattatgtgtattcgtgtatgtgtatgtgatatgtacagttgctggaggaggccagaaaagggcattggatatcttagaactggagttacaggtagttttgagcttctcaatgtggatactctagaagaacagcaacggctaaaactgctgagacatctctctagccctatggctaattttttataggaaactttgcagtcataaaatggtatttgttcaacaaacatttatctgaaaaggctttcgggtaaatatttaatttatttataaacatagtctcctttctatataagatgtgaaagtgttgtctgtctagtgaaattttaggaggtattataaggatgaagaacaatacaatttgactgcctctatccaaaggagttcctagagcctacctgttatttgtagctcatctctctgccaggtatttcattacctttaatacaaaagagtcctaaaggatattctgactctgtactatttacaggaaaatttcttattagacaatagaactgagagttccctgtattataggtgacttaagtgtaaacattaaataaagttccacagtggtattacaattgaaatgctttccaaataaagctatataatctcttgtctggaaacttcagaaaaaagaaaacttacctctcaggggtgatttaagaatagtctacagaggtgtactgagggacattttctgtttctatatgacattatagtacttaaagagtatttacaccaaataaagaatctgtcctgcctacaagatatgctggggcaatgggggttcagagctcatgggagtggctaatcaatgactggtctaacttgaggcccatgccataagaaggaacccatgacaacactgtctggatggccaggaactagaagtggatgatcctcagatctgtggtagaaccaaagactggctaaacaacaaaggggggaaaaaaacctcaatgaaatgattcctaatgatattctgctatactcgtagctgaatgcctagcccaatcatcatcagaaaggcttctttcagtagctgattggagcaaatgtagagatcttcggcccaaaattaggtggagttcagggaactggtggaaggaggcgggtagattgtagaagccagagggagtgaggacaccagaagacagggttcacagaattaactaagtggggctcataggggctcacagagactgaagggcaaccatggagattggatgagtctgtgccaggtactttgcatatatgttgtggttgtttagcttagggtttctaagggactcctaataatggaagtggggatatctctcttttgcctcttcttgggactcttttcttcttactaggttgctgcttccagccttgatacgatggtttgtgctaagtcttattgcatcttgttatgctgatgtaagcctttgctctggagcttactgcatcctgttctcatccttctttcccacaggcccttcctcttgttgttcccccaacatgcaatatctgctgcatttgttggtatagttcatttcttctcatctttcagtctccactttaaatgtcagattttcagactgatttcccaaagttgttagccactcaatttcacatcagagttaatgagaatccaataattacattttcaaatagtacatttcaaatagttaagtacatttgggatactacaaccaggaaaaagagtatgttctaaagccccaccctttaaataaaaattatccctaagaagcttattttaaaatattacttgaataaattcaaacttacaaagtaatgagcaaaatttcttggtggtacttacttttaagtgcctatcctagaataacattgggggaattacaaagttcatttgtttaacagatactgagatgggaatatgttatgctcttcactctgtgaagtgctagtgagacaaaagaccagattaagttagtccttataaacgaatggaagcactggaaagcaaccaggattaagtgtaggtagtaaaagtgctgacatgtttatgtgctaagggaatacatgtggaaggaaagccagggtattagagctgactcaatagaggaagtaggcttgtaagctgttatatgaaagtcaaatagaagttggacagacaaaggcaggaaggaagtgcgtaacagacaatcaaatccatgtgtactggccaggaggtaagaaagggcaatatattaggaggctgtaggaggtcagtatgaatggggcacaatgtagttacggaggggggacagaggtaaaaggaagaagctggaaatacagactataaaggattttatgtattgggacaattgggatttattttgcatacactgggaaggtgctgatgttctttaagaagagaagagacatgactaaattccagcttctgaaatcttgctgactgcagtgggaaagccagccactggagagaaacagccaggttccaaataaaggtaggtggacttaagtgtgcagtgatgatactcagaattccatttgagcgatgggatgggtattaacatttatggaaatggaacatgtaggatgagattaaaaacacaggctagccggacgctggtggcgcatgcctttaatcccagcactcgggaggcagagtcaggcagatctgagttcgaggccagcctggtcaccagagcgagtaccaggataggctccaaagctacacagagaaaccctgtctcgaaaaaccaaaaccaaaccaaaccaaaccaaaccaaaaaacaaaacaaacaaacaaacaaaaaaccaagaaagccacaggccagtgcttgcttcggcaacacatatactaaaattggaatgatacagagaagattagtgtggctcctgcgcaagtatgatacataaatttgtgaagcgttccacataaaaaacaaacaacaacaacaaaaccagaccagggtgaagcactgagtacatagaatgagataaaaacactagatagaggtgaagcactgagtttgatgcaccaacagaaacatttggtggagagttggcaatatggatggatttcatgaaaggctagcatttgggacaggagagacagttcaattcccaacagctacaaggtagatcacaaccacttgtaagcctatggaattcatagccctcatctggcttctgagggcaacagacacatatacacttggtgcataggcttacaaataggcaaaatacccacacatgaaaaagaataataataatataactaaaaggccagcattaaatgttttataataataattagtcctgctctgtactgtgtcaggcacctgagccttaggtgagtctgggcgctgctctgccccccaaaactcccccattaacccctgctcaattcttcctgagcccacctggacaagagtggacctgcccagaccagaaggcccaccctgagtctggacacaccttacccctgtccacactgcaccctctatctgcggtgggtgccggagcctcaggtgcgtctgtcccttaaactcccccatcaacctgtgctcacttcttcctgaaggatatgcctatggaagtacaagaagcttacagaacaccaaacagactggaccacaaaaagaagtctcctggacacataataatcaaaacatcaaacctaaagaataaagagaaaatattaagagcagcaaaggaaaaagaccaagtaacatataaaagcagacatttcagaatcacatccgacttctaaatggaaactttgaaagccagaaggtcctggataggtatcctacaaacactaagggaacatggatgccaacccagactactgtacccagcaaaactttcaatcactatatatggagaaagcaagatattccatgacaaaaccagacttaaacaatacatatccacaaatccaccactacagaaagttctggaaggaaaactccaacccaatgaagataggcacaaaacataggcaatagataatccaattttaccaaacatgaaaagaaatagtagggtgaaatccacacacaatgacaccatcaacaataaatccaaaacaaacaagaatcaacaatcaatgggcattaatatccctcaatgtaaatggtcttaacctgcccataaaaagatacaggctaacagaannnnnnnnnnntacaaagacagaatccatccttctgctacatacaagaaccacacctcaacttcaaagacatgctttaaagtcagaattcaacagcaatacaaattgcagaaaacctacaaactcatggaaattgaattgtaccattctgggttgaggaagaaataaaaaagaaattaaatacttcctagaatttaatgagaatgtagacacaacatactcaaacttatggggcactctgaaagcagtgctaagaggaaagttcacagcactaagtgcctacatgaagaaactggagaatagtcacactagagaattgacagaacaactgaaagctttagagcaaatagaagcaaactcaccatggaggagtagatgccaggaagtaatcaaactgagggctgaaatcaacaaagtagaaactaggaaaacagtacaaagaatcaatgaaacaaagagttggttctttgagaagatcatcaagatagacaaaccactatccaaactaaccaaaaggcagagagagagcatgctaattaacaaaatcagaaacgaaaaggaggatataacaacggacactgaggaaatccagagaagtatcagttcttactttgaaaacctatactccacaaaattcaaaaacctaaaagaaatggacaattttctggataaatatcacttaccaaaattaaaccaagaacagataagcaagtttaaatcgacttataacccctaatgaaatagaagcagtcatcaaaagcctcacaaccaaaaaaagcccagggccagatggcttcaccgcaaacttctaccagaaattcaaacaagagataataccagtactcctcaaattgttcaacacaataggagcagaagggacattgccaaactctttttacaaggctacaatcactttgctacccaggccacacaaagatacaactaaaaaagagaaccagagaccaatatccctcataaacattaatgcaaaaatactcaacaaaatattgtcgaatcgaatccaagaacacatcagaaaaatcatccactatgatgaagtaggcttcatccagggatgcaaggatggttcaacatatgaaaatccatcaatgtaatccaccatattaacaaactgaaaaaagaaaacacacatgatcatctcactagatgctgaaaaagcctttgacaaaatccagcatcacttcatgataaagatcttggagagaacaggaataacaggaacatatctaaacatgataaaagccaatatacaccaaactaacagctaacatcaaactaaatggagagaaactcaaagcgattcctctaaaatcaggagcaagacaaggctttccactctctccatatctcttcaatattgtccttgaagatctagctagagcaataagacaagaaaaggagatcaaagggatacaaattggaaaggaagaagtcaaaccttcactatttgcagatgatatgatactctacataagtgacccgaaaaatcctaccagggaactcctacagctgataaacaccttcagcaaagcagaaggatacaaaattaactcaaaaaaaaaaatcagtagccctactttatacagatgataaatggaatgagaaagaaatcagagaaacatcacccttcacaatatccacaagcaacataaaatatcttggggtaacactaacaaaaaatgtgaaagacttttacagtaagaactttgagtctttaaagaaagaaattaaagaagataccagaaaatggaaaggtctcccatggtcttggataggtaaaaatcaacatagtaaaaatggcaatcttgccaaaaggaatctacagattcaaggcaatccccatcaaaatcccaacacagttcttcacagaccttgaaagaacaatactcaactttacttggtcaaacaaaaaatccaggatagccaaaacaactctgtacaataaaggatgttctggaggcatcaccatccctgacttcaagctttattatagagccatagttctgaaaacagcttggtattggcacaaaaaagacagatagaccaatggaatcgaattgaaaaccctgatattaacccacacacctatggaagaaagatagcatcttcaacaaatgatgcttgcacaactgaattcagacatgcagaagattgcagatagatccatatctgtcaccatgcacaaaacttgaacattacaccagtagcacagacattcaaatctgcaattaataaatgggacctcctgaaactgagaaacttctgtaaggcaaagggcacagtcagcaagacaaaatgatagcccacagaatgggaaaagatcttcaaccacatagctgacagagggctgatttccaaactatacaatgaactcaagaagctagccaccaaaacaccaaacaatgaaattaaaaagtggggtgcagaactaaatagagaattctcaacagaggaatctgaatggcttaagaaagagctcaaaatctttggccatcagagaaatgcaactcaaaacaactctgagataccacctcacacctgtcagaatggctaaaatcaaaaataccaatgacaatctatgctggagaggatgcggggaagaaggaacactcctgcattgctggtgggagtgcgaacttgtaacaccattctggaaatcagtatggcgggtgctcagaaaaaagagaatcaggctacctccaaatccactacctcaagatccagcaattccaaattaaaacaactctgagataccatcatactcctgtcagaatggctaaaatcaaaaataccaatgacagtttatgctggagaggatgtggagaaaggggaacacttctccattgctggtgggagtgtcaacttgtaagaccactttggaaatcactatggcgactcctcaatgggaatcagtctaccacaagatccagcaattccactcctaggcatatatccaaaagaagcacattatagacatctgttcaacgatgttcatagcagcactatttgtaacagccagaaactgaaagcagcctagatgcccctcaactgaagaatggatagagaaaatgtggtacatttacacaaaggagtactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaatgcatgaaccccaggaatgggaaggggcaggaactcctcctgagctaattgccagcatgagggtagggaaaagggagctgccagaatgagaggaggagaggaggggaggagaggaggaaatgaaggagcagaaatattgaattgggggaagaatcgaggagaacattagaggagccattataggtctgaggagagatctggtactagggagatttccagagacctacaaggatggcacgaactgacaatctaggcaatggtggagaagataacctaaatgactttcccctataatgagactgatgactactttttatgccatactagagcccttatccagtggctgatggaagtagaggcaggcacccacagatatacactgaactgaactctggaactaagatgcagagagggaggaatgaagatcaaaggggtcagtaccaggctggtgagacccacagaaacagttggcctgtacaaggggggagcacatggaccccagactgctggctgggaggccagtacaggattgatccaaacccctgaacatggatgtcaattaggaggcctccccactctaggggtcccctggtagtggaatgtatttttccctggtataagaagagactttgagagcccatccctcatgaagggacacactttcggcctggacacatgggggagggcctaggcctggcccaggatgatgtggtggactttggggagcccccatcgagggccctaccctgcttgtggagtggaggatggatggggtgggggataggtcggggggggggtgaggggtggagggaagggagggggattgacatgtgaaacaagcttgttcctaatttgaataaaaaaaaagaacaaaaaataataattagtcccttccttttggttctatcttagaaacagatgccccaactcacacccatagagattttcttcccccccccaaaagatccccaaaccagggactcactatactgcactggctatccgggcactctcagacatccgtctacttctgcctcctgagtgatgggattaaagatgtgcgtcatgatgccctgctgaaaatatttttgtttttaagtgaacttcaattctaaattgcattgctgtgtgctttaactgtgtgatatgactgaggaagtactggaaaggagccaggcaaggtttccttccagtttagcaacccttttgaaaaataccacaaatactgtaagtaacaatcaaaaaagttatagttccctaatgcatttaggtaaggggttatatctgaaacatggactgcagagacggctcagtgcttacagtgtaagcatgaggattgggatctggatccacagaacctacataaatgttgtgtgtgcatgctgacttacctgtgattctagggctcacttcaaaggcagaaacagggaatcctaggagcaagttggctagttatactagctgacaagctctaagtgtaattcagagaccctgtttcaatgaaggcaaaaagtgatcaaggaagactctggatatcaacttcagaccttcaaaaacatgcacttgcacatgtctggacacacagacacacatacatgaggaaacaaagaggcttacattttcagcctttacaagtcagttaatctaactgttccaatcaatactattgaggcatatttttaagacaaggtggtgctgtgtagaccatggttacaacttataaggggaaagtcccccattgcatgaaaaccctttctgctgaccaaagattaaatcaccagaggttctattcaacaatgtatgagaaaattaaaaacaaaaggtatactattcatctcagggaaatgatggattttccagctgcagtaagtacttttttttgaaatcctctcatgacagattaacacagcattgccagatgtttcttttctattgaagtatactataatatgcttcagctacttttagtaattatgcatttgtaatctgccagtacctgcagctgctgctcatcctgttaattaaaaaaacaacctttaaaaaacagttatagtagtcaaacattacagatgtacagccaaaaaattacgttttagaaagtaaaaagaactccttaggctcaaatgctatgtaatcaactacacacggacatagagacagatagacagacagacagacagacacacacacatagactcacagacataaacacagaactgagcatctctaatctgaaaaactgaaatatgaagcataaaatattctcaaagtctgaaaaatataagtctggggagcaggaagatggagggaggagccagagtaacagcagcttataactgtacattttatcagctgtttgttcattacttgaacacaccgataatgaacagcccatttcaatctcattgactgtgtcaggtaagatgttagcttacagttctgtaaaagccacagcaataggtagtttctcctataattcagtgacataaaaagactgagtaggctagtaggggagtatagaacaaggaaagaatgttttagggcaatatggatactttatacagaaaaaaaatgacatttgagttgtgtctggagggaaggtaatttttttgtttagggaggtgggaaaggataggtacaaagagcaatagtatgtacaaaatgatcctaagtcaccttttactcttacgtgttcttttttttttttttttcatttttaaatgatgatgatgattttttaaatcccaacagcactttcccctacctcttctctgacgagtccctcccccatccactcctcctctgcttctattcagaaaagggcaggcctcccatggatatcaaccaaacacagcatatcaagttgccataagcttaggcacctccctcttattaaggctggacaaagtgacccggcaggttgaaagtttactaaaagccagcaaaagagtcagagaaggttctgctcccactgttagaggagttccacaagaagaccaagctacacaactcctctgtctgtctgtctgtctgtctgtctgtctgtctgtctgtctgtctgtctatctgtctctatgtccgtgtgtagttgattacatagcatttgagcctaactacacacacacacacacacacacacacacacacacacacacacacacacacacacacacatacacacacacactggacacacacacacacacggcccaggttagtactgtgcagactccatagttgttggttcggtctctgtgagcccaggttagcttatggattttcttgtggtgtccttgacctctatgggtcctccaatcctttctcgctttcttccacaggattccctgagctctgactaatatttaaatgtgggtctctgcatctgttgctaccagttactggataaaacctcccatctaatgacaactggactgggcaccaatctatgagtatagcagaatatcattaagcctcatttcattgacttttttatttttattttttgccagtattgtttggttctatcctaggtctctgggctatacagcctctgtgtccttgtactccaggctatgtcagaggtgggcctcctcttgtggcatgggtctcaggctggaccagtcactggggcccctcccacaatttctgtgccatctttaccacagcaggtcttgtgtgcttacaggagatggccagttcaggctctgtattccccattactacaagtcttagatttacttgcagatttctgagttttcattgcactaagcttctttctatcttatctctaaatgcctccctctttcagtcatttctttcagtactctcctcctccatctccccatgcctgattactcctattcccatccctgtctacccttagtccacctgcagaatctattctatttccccttccctgggagatccaactgttctccattgagccctccttgttatttagcttctcagggtctgtggctttcctttactttacagttaataaccacttacaagtgggtacataccatggtttatctttctgggtctgggttcatttactaatatgatattttctagttacatccatttgcctgcaaatttcatgatgtcactgttttttaacagctgagttattactgtgtattcattgtgtaaatgaattaaattttctttatccattgtttagttgagggccacctaggttgattctaggttgtggctattattaataaattaagtggccttgtggtatgatggagcatcctctaggtatatgcccaagagtgacatagctgtgttttgaggtagactgatctcaatttttggagaaactgccatattgatttccaaagtggctgtacaagtttgcactcctatcagcaatggaggagtattgcccttactccacatcctttccagcatgagctgtcacttagccattctgacaggtgtcagatggcatctcagtcattttgatttgtattttcctgatggctaagaatgttgaaaattgctttaagtatttctcagccatttgggattcctctgttgagaatgctgtttttatctgtaccccatattttaactggaatatttggtttgttgaggtctattttcttgagttctttgtatattttggaaatcagccctcttttagatgtggggtttgtgaagatattttcccattatgtgggctgctgttttatcctattaatggtattttttactttacagagcttctcagttttaggagggcccattaagtaattgtcgatcttagtgcctatgctatctgtgttatattcatgaagttatctcctgtgccaatgcattccaggctatttcctactttctcttctgtcaggttcagtttatcttggtttgtatgttgaggtctttgatccacctagacttcaattctatgcagggtgatagatatggacctatttgcattcttctacatgccaatatccagttagatcagcagcatttggtgaagatgctttcttttttccactgtataattttggcttttttgttgaaaatcaagtgtgtggatttatatctgggtcatcaatttgattccattgatccacctgtctgtttttatgccaatacgatgtggtttttattactatagctctgttgtagagcttgaaatcagggatgatgacacctctgaaagttcttctattgtacaggattgttttggctatcctgggttgttttcccatatgaagttgagtattattctttcaaggtctgcaaagaattgtgttgggatgttcatgtggatttcgttgaatctgtagattgctttagtaagattgccatttttactatgctaatccaacctactaacacatgagaatgggaagtctttctctcttctgatacttctccaatttctttcttcaaagactcaaagttcttgtcatatagtctttcacttgcttggttagagataaaccaagatatattatttgtggttattgagaagggtgttgtttccctgatttccttttcagcctgtttatcattagtgtataggagggctactaacgttttttgagttaatcttgtatctagccactttgctgaaggtatttatcagccgtaggaggtccctggtagaatttttgcagttgcttatgtagactatcatatcatcagcaaatagtaaaagtttgacttcttccgttccaatctgtatccccttaatagctctagctagaacttcaaatactatattgaatagacattgaaagagtggatagccttgtcttgtttctaattttagtggacttgctttaattttctctctatttaatttgatgctgcagtttgctttctatatattgactttattatgtttaggtatgtgccttatatccctgatctctccaagactttcatcatgaaggtgtgttggatttttgtcaaaggctttttcagcatctaatgagataatcatgtggtttttcttttcattcagtttgtacatatggtggattacactgacagattttcatatgttgaaccattcctgaatcactgggatgaagcctccttggtcatggtggatgatctttttaatgtgttcttggattcagtttgtgagtattttattgagtatttttgcatcaatgttcatgagggagattgttctgtaattctatttctttgttgagtctttgtgtggtttaggtatcagggtaactgttgtctcataaaatgaatttggcaatgcaccttctgtttctattttgtggaataatttgagcagtattagcattaacccttctttgaaagtctggtagaattctgagctaaaaccatctggccctggcctttttttggttgggagatttttaatgattagttctctttccttagggattataggtatatttaaattgtttatctgatcttgatttaactttggtaagtagtacctatcaagaaatttctccacttcttttaaatgttttccaattttgtggagtctaggttttctttttttccctccatttgttaatttaaattagaaacaaaattgttttacatgtcaatcctagttttctctctccccttctcccctgccccccactaacaccctacctatcccataacctttctgctccccagggaggatgaggccttccatgggtatctttagagtctgtcatatcttttgggatagggcgtaggccctcccctgtgtgtcaaggctgagggagtgtccctctatgtgaaatgggctcccaaagttcattcctatgctagggataaggactgatctactacaagaggccccatagatttctgaggcctcttcactgacacccactttcatggggtctggatcaatcctatgttggtttcccagctatcagtctggggaccatgagatcccccttgttcaggtcagttgtttctataggtttcaccagcctggtcctgaccctgttgctcatcattcttccctctctgcaactggattcccagagttcagctcagtgtttagctgtgggtgtctgcttctacttccatcagctgctggatgaaggctctaggatggcatgtaagttagtcatcaatctcattatcaggggagggcacttaaggtagcctctccactgttacttagattgttagttgatgtcatccttgatatctctggacatttccccagtgcctgatttctctttaaggagtacaggttttgaaagtatgacctaatgattttctggattttctcagtgtctattttttatattctcctttcattactgattttggtgatgtggctattctctttgtgcctttttgttagtatcttgtgattttcacaaagaaccaactctatttcattggttctttttattgttctatttgcttctattttattgatttcagccctcagtttgatcatttcctgccatctactcctcttgggtgccttttgttttctagaacttccatgtgtgctgctgctagtatgaggtctctccaaattctttatgaaggcacttaatgatatggactgtcctcttagaaaggcttccattgtgtcccataaatttgggtatgttgtaccttagttttcattgaattttaggaagtatttaatttccttctttatttctgcttttaaacaatagtcatcctgtatagagttattcagttcccatgaatttgtaggttttctgttgttgttgatatccagctttaatctgtggaagtctgaatttcaattttcatgtatctgttgagacttgtggtcaatttttgagaaggttccaggagtgctgagaagaatgtattttcctttgtgtttgggtgaaatgttctagatattggttaggtccatttggtttatagtgttggttaactccattatttttctagtttctgtctgggtgacctgtccattgctaagaatggggtattgaagtctcccatcatcaatgtgtgaaggtggatatgtgatttaaactttagtaacatttcttttacaaatgtgggtgctgccaggcgttggtgcacatgcctttaatcccaacatttgggaggcagaggctggcagatctctgtgagttcgaggccagcctggtctctagagccagtgccaggataggctccaaagctacacagagaaaccctnnnnnnnnnnnnnnnnnnnnnnnnnnnnnnnnnnnnnnnnnnnnnnnnnnnnnnnnnnnnnnnnnnnnnnnnnaaatgtgggtgcctttgcatttggggcatagatgttgagaattgaaacatcatcttgttggatttttcctctaatgaataactcttttaattttggtttgaagcctattttcttggatattagaatagctacaccagcttgcttctaggaaccatatatggaaagtcttttcccaactttttactcttaggttatgtctatctttgatgctgaggtatgtttcttgtatgctgcagaaggatgaatctttattgtgcatccagtctgttagtctgtgtcttgttactggggaattgagccagttgatactgagacatatcaattaccaatgattgttaattcctgttatcttgttgtagtagttgttgatgttactgtatgtgtgtatgtgctttccttctttgggttacaatggtgtgagattatttactgcctatgttttcatagatgtagttaacctccttgggttggagttttccttcagtaccttctatagccatgatttttgaacaggtattgtttaaatttgactttattactgaatatctcattttctccacctacgggattgaaagttttgttggctatagtagtctggactggcatttgtggcctggagcacatctgtctaggcccttccagtttttagagactccagtgagaaactgggtataattctaataggtctgtctttatacattacttggcatttttctcttgtagtttttattattttttctttgttctttttgtttagtgttttgattattatgtggtgaggggattttcttttctgattcaatatagttggtgttctgtaagcttcttgtatctttataggcatgtccttatttagattaggaaaattttcttctatgaatttgttgaaaatattttctggacccaaaggtccagagctggggatcttctccttctattcctattattcttaggtttggtcttttcatagtttcctagatttcctggatgttttgtgtcacgaattttttacatttaacattttctttgattgatgtttttatttcttttgtcttgtcttcaatgactgaaattctctcttctaaatctcctgcattgttgggatgcttgtgtttgtagttctgtttgttaactaaattttccatttccagaattccctcagtttgtatatatatattttttattgcctgtatttccattttcaggtcatgaacagttttttaaattaatttttttatttaaattaaaaacaattttattttacataccaatcccagttccttcccatcctcccattcccttcacatctccccatcccaccctcctatccactcctcagggagggtgaggtctcccagggggatcatcaaagtctgtcacatcatatggggcaggccaaagccctccttcctctgtctaggctgagagagtatccctccatagggaatgggctccaaaagcccgtcatgaagttttatttgtttccttcaactgttcctccaccccccaaccttcctgacattctttaagggatttattgatttcctccaattttttttattatttttcctcgatttctttcttttttcatctacaaacagttttagtaaacatttggatgaaaaaaaaaaactcagaagaaacatcaatgacaaactggggaaaatattacaatatagattacagtctgtcatcagaataaatataaataaataaaaatcacagaacccttttaatgtgagggggaaacaaaatcataaataagaataggcaaaagacatgaacaagcaattcaaaaccaagatttaaaatgcctgtaagcttgtgaaaagatgtattctatttgctcagtctatgaggaagcatacactttcacaaatcattggtggtaaagaaaatgaatgcaaatcttttagaatgagttaggaaaaatgttagtatctacaaatttcctttaactcaccaatcatacttataaatgtttattctggaagcatacttctagcagcatgaaaatgttcatacacaaaattatccactgggatagtactggttaatagtcattgggaaaccctagaaggtatgtcaatgtccaaatccagtagataggttatatatgaggtccaaattgtcatcacatgcctctagtaagatactctaagaagggcatatgttatggatgtggcattccttccaagaatgtgtaccttgtatttaaccatctgataatatcagactatcaaacaatgttccctcaatttctttaaggaatttattaatttcctctttaaggaactctatcatcttcataaagttggttttaaggtcgttttcttgtgtttcagaccccattaatgtaggtgccagtgaggagaactcagaaatctatggtgccccttgtagtagtagatcagtacttatccatagcataggaatggactttgggagctcatcccacatagagggatactccctgagcctagatacacggcagggctggcggggtgtgtgtgtgtgtgtgtgtgtgtgtgtgtgtgtgtgtgtgtgtgtgnnnnnnnnnnnnnnnnnnnnnctaggccctatcccaaaggatattacagactctgaagaccccctgtggaaggcctcaccctccttgggcagcagaaagggtatgggatacataggctgttagttggggggggcaggagaggaggggagggaattgggattgacatgcaaaacaatcttgtttctaattcaaataaaaaaaatggagaaaaaaagaatatttagggcttgttgtaatgggatggctgggctatggtggtgacatagtgccttgctgtggttgattgtgttcttacactaacatttaggcatctggatttggagtgattataggtctagatggtgatttctgggtttgtctttgttggatggatattttccttctaggtttctgtttcctctctggtctttgggctggagtggcctggttttcagggagctggcctggcctctgctgggaaagaaggcttttgctagaggtatgggcaagtgttccttcttattctgtattcagctatcagaagaatctttactaattctaaaaaagatccaaaatatatctgtctttccctttcttcttctcaaaatactaccccctatccacttcaaacacacataaaaattgagaaattctaaccttaaaaatttactgttgggctggagagatgactcagtggtaatcagtggtgcttgacaagcttgaacacaagagttcaatcccagaacccgcatggtggaagtagagaaccaaattcctcaagtcattccctgatgtctacatggtgccaagatatacaagtacctccactttcacaaaataaataaatgaatgtgaaaagtttactattctatttttttttaccaactggctcataattgcaaaatcctgtgagaatggaagtgacaattcaaacataactgtgctgtaacaaagtggaacttcttatatgcaaccattttggtatctgttatccaacttttaccctctttctcactctgctgcttggcctctagtgaccaacactattatatttggccaagattttagctttcacatatgaagctctcacttgcctttctgtgcctggcttatttcacttaatatcttttagcaatttcactacaattgatttcattcttattttaggacagattaatagtccattgtgagcatgcatacaagcagatatacagtttttattcatctattcaaccacctatgacatatgaattgtgtacatttaggttattatggataatgttcaacaaacatgggacattactttgatattgcaattacatttgatttcctttagatcatacttattattactgtgttagctgtatcacattgcacttctattttaaagttttatggatgtctatgcttgctattatggctgcattaatttaacttcctaaaccaccattctctcttactgatgttctatcaatagccttctaagggattcccaagcttttctcattttattcctcacatgatcaacacattgagctttccctgaaacaatataaccagatcaggtgacttacctttgaaaatggtccaaaggcccaggggtagggcagagacagagggagagacagagataagagagatagagatagatagagagcgagcgagaatgagcaagcgagtgagctcagctgagcaaagtccaggttgagagtggcctggaagctgggggtggggggctagtgtctcagccagcatccagtgccattctctgtatgagataccaagctgcatcaatgaccagtggagcatcagacccacatgcatatagaggaataatcaccaaagcagggccccacctatacctggaggaacaacctgtggagccttggcagcacctacacctgaaggagtgaacactggagttgtgtccccacctacactgagaggagagaccatctgagctttgagcctccccctagacctggagttgcaatcaactgagccacagtacccaaatgcactaactgaaggaagagagaccccttgaagcacaggctccacctgtacctattggagaaagagatgggtagacaacagtgtaaggatacactaaataacacaaagattgatatggctccaccagaaactaggggttctacaacagcaagacctgaacatcctaatgtagacgaagcagaagaaacaacatcaaaataactttatgaagatgattgagacccttaaagagaaaatgcaaaattcccttaaagaaatggagggaaagataaacaaaatattggaagaaatcaacaaatcccttaaagaaaaccaagaaaaatcaaacagatgaagaaaattattcaagactgaaatataggcaataaagaaaacacaaactgagggaattctagaaatggaaaaatctgggtaaacaatcaggaactacagatgcaagcataaacaacagattacaagagatggaagatagaatctcaggcgtcgaagatacattagaggatatagattcataggtcaaaaaaaatgtcaaattcaacaagaccttaacacaaaatatccaggaaatctgggacaccatgaaaagcccgaaaggaataataatagggatagaagaaggaaaagaagtccatctcaaaggcccagaaaatatattcaacaaatcatagaagaagacttttccaacctaaagaaggacatgcctatgaaagtacaagaagcttacagaacaccaaatagagtgaagaaagaaagaaagaaagaaagaaagaaagaaagaaagaaagaaaaggaccaagtaacatataaaggcagatctatcagaattacacccaatttcttaatggaaacaatgaaaggagaaggtcctggatagacgatatgcagacattaggagaccatggatgccagcccagactactttacccagcaaagctttcaatcaccacagacggggaaaacaagatatcacacaacaaaactagaaataaacaatacctttccacgaatccagccctacagatagtactagaaggaaaactccaccccaaggaagttagcaatacacacaaacatagtcaataatcccacaccagcaaattccaaagaagggaaacacacacacaataccaccaccaccaccaaaaacaaaaataacaggaagtagcaataactcgtcattattatcccttaatatcaatggactcaatttacctataaaaagacacaggctaacagaatggatatgaagacggaatccatccttctgctgcatacaagaaacacacttcaacttcaaagacagacattacttctgagtaaaaggttgggaaaaattttccaattaaatggacccaagaaacaagctgatgcaggtaatatctaacaaaatagacttcaaactaaaagtaatataaagagatgattcttcgagaaaatcaacaagatagacaaacctttatccaaactaaccaaaggcggagaaagaatacccaatttaacaaaatcagaaatgaaaaggggaatataacaacagacactgaggaaatccagagactcatcaggttatacttaaaaagcctgtactccacaaaattggaaaatgtaaaggaaatggacaattttctggataagtacacatagcaaaaaagagctaataccagtactcctcaaagtgttccacacaacagaaacagaagaaacattgtgaaactctttctacaagttacagttaccctgataggcaagtcacacaaagatgcaagtaagtaagagaattacagaccaatctcccacatgaacattgatgcaaaaatactggcaaattggatccaagaacacatcagaaaaagcatccaccatgaccaagcaggcttcatcccagagatgcagggatggttcaacatatgaaaatctgtcaatgtaatctaccataaacaaactgaaagaaaaaaaaaacacatgatcatctcattagatgctgaaaaagccttaagcaaaattcaatattccttcataataaaggtcttggagagatcagggatacaaagaatacacctaaacacaacaaaggcaatatgtagtaacccaatagtaaacatcaaaataaatggagagaaactcaaagcaattccactgaaattaggaacaatacaagtctgtccactctctccatatctatctaacacagtactcgaagttctagctagagcaataagacaacaaaagcatatcaaggggatacaaattggaaagaaagaagtcaaactttcactatttgctgacgatatgatagtttacataagcaaccccccaaattctatcaggaaactcccacagcagataaataccttcagcaaagtggtaggacacaagattaacttaaaaaaaaaaaaaagagtagcactcctatatacagatgacaaatgggctgagaaagcaatcagagaaatattgcccttcacaatagacacaaacaacataaaatatcttggggtaactctaatcaaacaaatgaaagaccttgacaagaactttaagactttgagaatgaaattgaaaaggatttcagaaagtggaaagatctcctatgctcttggacaggtaggatcgacacagtaaaaatggcaatcttaccaaaagcaagctacagattcaatacaatccccaccaaaaatcacagcacagttcttcacagacctagaaagaatagtactcaatttcatatggaaaaacaaaaaatccgggatagccaaccctgtataataaaggaacttccagagacatcaccatccctgacttcaagctagagctacagtaatgaaaacaacctggtatcagtaggagcaatggaatcaaattgaagaccttgatattaacgcacacaccaatgaacacttgatttttgacaaagaagctaaaattataaatggaaaaaagaaagcatcttcagcaaatggtgttagcataactggaggttggcaaatagaagaatgcaaatagatctatgcacaaaactcaagtccaaatggatcaaagacctcactgtaatccaaccacattgaatcttacagaaaaaaagtgggaagtacccttgaacgtatcagcacaggagactacatcctaaatataataataccagtagcactgactctgagagcaacaattaatgggatctcctgaaacagatgcttctgtaaagcaaagggcatagtcaacaagacaaaatggcagcctacagaatgggaaaaagatcttcatcaaccccacatctgacctctaaatatatgaagaactcaagaaactagacaccaaaataacaaatattccaattcaaaaaatggggtatagatctaagcagagaattctcaacagaagaaactcaaattgctgaaagacatttaaggaattgctcaacatccttagtcattagggaaatgcaattcaaaacaattctgagataccacctcacacttgtcagaaaggctaagatgaaaattactgatgacagcttatgctggaaaggatgtggagaaagggaaatacttcaccatgctggtgtgattgtaaacttgtatagctgttttggaaatctgtatggtgatttctcagaaaattgtgaacaaatctacctcaagacccagcatcaccactttcgggcatatactcaaaggatacacactcacaccaaaagggcatttgctcaattatgttcatagtagcagtattcataatagccagaacctggcaacaacctagatgctcctcaactgaagaatggttaaggaaaatgtggcatacttacacaatggagtacttctcagcgttaaaaaaacaatgacatcttgaaatttgcaggcaaatggatagacctaaaactaacccattatgagtgaggtaactcataccggaaagacaaatatgaccctccatccagcaactgatggaagtagatgcagagattcacaattaacaactgaaccgagctcctggagtctagtggaagagagggaggtacgataatatgagcaaaggagtcaagaccagaatggggaaactcacagaaacatctgacccaagctagtgggagatcactgactctggactgacagccagagaaccttcataggacctgaatgcaggtgacagtgggtggcttgggcagtttgtggggccactggcagtgagaccaaaatccctaatgcataaactagctttttggagcccatttcctatggagagataccttgctcagcctagacacagggggagggtcttggtcctgcctcaacatggtgatacaacagagtattgattccccatgggaggccttaccctctctgaggagcaaaagggtgggggtgggttgaggagaaagtaggggaagtgggaggaggggaggggggaactgggatatacatatgctttactatcaaaaaaaggaaagaaaggaagaaaggaaggaaggaagaaaggaaagaaggaaggaaggaaggaaggagaaagaaaggaaaaatgtccaatggctttctttaaacactatagtaaggctcctacataatgaggttcctatccatagctatgacacagattacctgtggtccaccattgcccagactcctgtgctctacagctacagtgtgacccaaaggacaaaagacgaagtgagctgaggcagtgaggactcacactccacttccattcctcttcccttgtgtctgagatctcagaaaatcatgttcaaaacagtagaagcaatagcaggagatttccctagctaatcatcttatacacgcctacgaagatgaaaaaccttctactgattagttcacgatcacactttgtcattgaacttggcattaacacactgctgaaacctgacctcatcctctaccatttctgctttccatttgcacaccaattctttcacatgggataagacacgtgtatgcatatacttttatttctgcctggaatgctcatttaggatatttagatggacactttaaactatcttaagtttcatttttttacagaagcttccttgtctactcatacacaggaattcactaattcattaccaaaatggcttatttaaaaattttgacatagcactccttttctggcttgataatattaaaaggggaggatcccagtctctgctaaatccttactatttccaggccagtagcttttcaataaatatgagatgaatgagaaatttgaagactaagctgttgaacaagggctggccatccacccttggtttagatgtggtgattaaggatggctaaaacacaggaacacaccagagatagagaggcagaatacaggtaagtaaggcagagggaaaacaatcatgaaaataccaacataaagttgtaaagtggccagggctagcagcatatttacttcttagaaaagccactctgacagctgtatagaagctggaacagaagaatgatgagagatcagactgaagtaggtttgttttttaaagagctgttgtcaaagacctgaatgggcctgattgactgcacagacaaaaaagtgactgcatgttagcacagattcacctacattatcttagagaaggatttaccagctcacatcttcaacactgcctgcctattcctatttctctaaatacctgcagacactggatgtcagttacatttgatattttggctaactttctgggtaaaactattgtttaggtttgtattttttcaaggcagagggaggctgaacttgcttggatatgtttaaaggtgttctgcatttatcctgagagctagcagttcatgcatgtgtccattcttctcttaggccacccaccttcctgaaaattagcctgtttcctttcccagtatgctacttgtcttttgtctttatttagcatcatttttcacagtgattttcattttttactcttccctttttgggggctttacgttttgtgttttgattcaaagaattctttattctaaggaaataaaaacaatatattacacagtcttttatatatttagctcttcaatctatttggaatttattttatatataaagaacaatttaaattatttattgtctctctaaaatcatctttcactattggcttggaaatgcttccattaccatgaacaaaattaccaactaactgtactcagtttctacattctgttcaaattaacacaagagcactcatgcacacatgccatgtatgagcacatacattgttttttcttgagacaaggtctcattttgtatctaggctggccttgaactttttttttttccccaaaacttcctatcactttaactttatttatttattttgacaatttactgtccaagtattgtgctgccatcttagggaattttgtacatttcctttttaatttttaaaatttagattctttaattactacttatatttacatatccatccccccattccctcgccctcccatcctcccatgttccccactaaccctcccaacccatccctcaactcctccccagggatagtgaggccctccaccagggaccttcaaagtcagtcatatcatttgggggagggcctaggccctccttgctgtatctgggctgcaatagtatctctccatagggaatgggctcccaaagtctatttgttctctaggcttaaaagacccgctccactgttagaggtcccatagactgtcttggcctcctagctggcacccacattcagagggcgtggttctatccaatgctgttttcccagctttatgactaggggctggcttagaaacttatggtgatccttttgcttcagtttcctgagtgccgagattacagatgtgcacctccatacctaacttccttaatgtttctaggttcttgattttctttgaagatttatgtattttattttttatgtgtatgagtgttttgccttaatttatgtctttgtgtcatgtgtcatgcataagtcagaagaaggtgttggatcccccagaactgaagttatggatgaatttgagttaccatgtgggtgctgggaatcaaacctgggccctctgcaagaacaacaaatgctcttaattgctaagccatctccccacctcttatgttttattttaaaggacattactgtcattattaataaaaggtctaagtgactgaagtcctgacttactatgaaaatataactacatctaaggggagcactccaattacttttgttgctgatccacgttgaccaaaatcaacttggggaggagagggtttaatcttataggctagagtccgtcatcaagggatgccagtgcaggggctgaaggaggaaaccaactcagtgtgtgtattaaatggagttatataacacactgataatgctccttgtaggaaacacagactaacaaaaaaagccccagtgccaagcaaggaacatcccctttctcaagttattggtctcttggatcccccaaacaatataggctatttccactattcttagttgcacaccaaaacatcacacactccatacacacacacaggacttgaggaattaagctggcactgatttggaaatcatctttctgagagctagctttctcagtttcttaaggtactatataagcttccaagagaggaaagttatgaataatcctactcaggtgtaaagcctatgagcataacaatgacagacctgcacaatcccctgagcatgggaagaggggggagggagctacgagaatgagaagggaagaagagaaaggatgcagaggtcatgagggagcagaaaggttgagtcaggtgaagattagaggaaaggatatgtgataggtagggttttagttgggggggtggtaggggaggaagggagggagaagggaactgggactgtcatgtaaatcaatcttgtttcttattcaaataaaaaaatgataaaaaaaagacagacctggcaagatattcccaatggtgcaatagtgccactttcatcttgggggtaatcaacagttgtctaattcaataggaggaaattcatgcctgatattgtaatctagaaaactactcatggatagagagataacaggatcctagaagagaacctactactgcaatttttctaaatcaatatagtttttaattgtattttaatacttattctgatacccctagattaagcagagttctcattctgcatcaaagaagcttctgtttgaagaagacagaggctactacagagatccaaaactggtcaaaatgaaaagaatacgtgactgtggggtgcctaattctctattggcacatcaaggctggagagatagttcatcagttagtgcctaggctcacaaccaacatatcaactggtctatctacaatacaatccctatgcctagggctcaggaaacactgtggagagttggaaagattgtaaaggccagaggaccaggacctaagcttcaagttagtgtcttctatatatgacagggatgttgcactcatgaaatctcaatatggctgtctaaagatctacataatgaccacatcagctgtagggccagcaggggtgtggggatttccacaaggttcaacccccccagatgaagagctacagggagaatcagttttctctagaaaacagttctgaggctgggttttaaagatagatagaaagggaagctttgaaatagaaaaatgaaaacaaagcaagatcccagtcagagttactggattcaagtatatagttgggagtcaactgtctaggcaggtggcagacttgttactcatatgaacatctgggagtattggaacagcaatggtggaatatccaaataaaatttcaggccaagatcacatttaagtaggaatactccttggaaggttggttagttttaagttgcttacttcatggagtattttgacttatttctcttagtgtacttagctactatctgatgctatgctacttttatagaaaactgattttaaaaagatctttattatctaaatgggactccaagaaggaggcaatgtaaggaaacagaaattaaatctagagatgactggagaggatggcctacactggggcctggacaaccactgtgatagcaaggaagataagaacagatgcaaagaatataaatgcagtaacataaactggaatccttttgtgatactttctcttttctcaatgaaatggcaattgaggttactgtattagttacttttctattgctctgctagaacaccatgaccaaggcaacttacataaggaagagtttatctaagccttagggctgcagagggtaagagtctatcaccatcatggtggggaagtgtggcagcagtcaggcatagtgactgtggcagaaagcagagatctcatatgtagaaccctaagcagaaagcacagagagaaactgaggatggtgagagaattttaaatctctgaggacctgtgtggtgtgctgtactcattcaagaagctgagtataaccaactgaaaaactccagtttttccttcccagagcttcatctagctttaccatatatcatacaaggtaaaaatttaaaatataagagcatattagtactttttagtcaaagatcaaccaactataagcgttctttaattaaaagcaatgtggcataatatatgcaacattagtataaattactctgatattaatttcccatagtagttctcaaaaaagtctgtagctatagtctattttaactttccagatgctgccactagctggccacatgatcaagtgacctccagtttgcagtaagacacatggaccactgtactaaatgaaatagaattatttttaaaaaattattatttttactgactttttgtgaaattttatacctatatacgatgtaattgatcaaatctacctcacttcccaacttcatatcttctgtcttgttctgaaaaataatgagtccaatttgtgctacccatatacatacaggagtggggacatccactggagtgtggtctcttcctccccatctagccatcaactgtcaatagctcttcacttaggaagtgggggagggtcatgagccttttctcctccatgttaaaaattattattaaaacaaaaaagtgatgaaaatagcatattcaaaagccctagtatgatgcctgaatgaaacaaaactaacaactaaaacaacaaactgaacactggagccagcacttcctgtgccatgaaggacatttaccacatttcacacgtgggatatggttttttgtcattcagagaaagggctttggtagagacacactataattgacctggggttccagagtctttcctctcagggaaaaggtgagccacacctgaattcatgtccctgataaactatgaggcatgctaaataatcctgaaaccactgtattatgtggaatgttcactaaattaataaaacaaggtattttatttgacttataataccattttttctttctctttttggtgtgtgtgtgtgtgtgtgtgtgtgtggtgtacacatatatgcttctgtgcataggtatgtgtccatgcagaggccagaggtcactatctcatatcttcctcaattaatccatctctcagggaacctggagattaatgatttggctagtctggctggatgtcaagccctaggatgccctcttctcagtgctagtgcacaccaccatgcttaactttttacttaggtgctagggatctgacatcatgggtgtcatctactatttttttttttttttttttttgagacagtctctcactgactaggaactaaataagtaggcaaggatggcgggccagtgagcccaagtatctatctgccactaaaactagtgctttttttttttttttttttttaaagaacgtggttttggaggatctaattcaggttcccatgcttgctagtgttttactgagagagctatcacccactcctcagaattatacattaaacaaacaaaccaaatagaagagaacaataaactatagttttaaatcatttcttctgtaaaaaatctattcttaaataattattaatagtaaacttactttgtattgctgttttgtaaagcaagtatcaagcaactacaaacagtggacctactttagactgttgatcctcatttctgcacattcagtaagtttctttgtttcttctttccacctattggctgccttttgttgagctgccaatagatgcctcagttcaacaatggaattccgattactgtcctccatctctctcaactgaacttcaaacccatgttcctttattgagaactgatgctccattgtactgacctaaggagtaaaaggaacagttattttcctctcaggattctaggagttatgtgagccaatgtcatacacaaaaagagtaatccattgtccttatgagatttagaaacctctaggtgaggcatctaagtaagcagttaagcatacaatttgtctccaccatgaatgaaatggatgtatactttagtgaaaacacaactaccatggactgtgtgtgtggtttttcaagacacactttttctgtgtagccttggctgttttggaacttactctgtagtccaggctagtctttaactcaagagatacacctgtatctgcctcccaagtgctgggattaaagctatgtgcccatatattttattttcaagtttgtaaagtagtacaaattactttgcatatgtaatgcaaaagatgaaatgtcattttatcttttaaatatggatctaattgaattagtattataattgcaaaaataattcttttcctcttgaaccacagtgtgcttctgctacaaaattaggtcatcattacaacataatttatttctggactttagtttgtgctactgatcaatacaattattttgatgttgacaatacggtctaattactgtagctttatacagatatggttctttttcatattttacagagtaaaaatctttgtaagacacatgactatttttttcatttctgacttcatatccttatgaatgcttacagtcctggatacctgcaacagaagacagtcagtaactgcatgttgataggaattaggtcagaacatgacatcttatgattccttgcagcagcaataaacaatgtgaaacaacagtattgctactttatttacattctcactgtgagcctgaaagatgaagatctttactataaaaagctagtgccatttacaaaaatataatggaatggagggagataaaagagatgttgatggaataccatgtgtttcttggaagtgccttaaatggattatcacagggtaaaggaagaggaaaggggagagaaaataaaaggtaaggatttttctcagatgagacttttgccctgtgcattcttcttgctgctgtttttacactagctaggaggtcctctcagagaaaactgatagaacatcctcttacggatgttgaagaaattcaatgtaagaaattaatgaaggagaaaggatggcagactaaaagctggtagtgcccaagttgctttggcaagatcattttgttgtatggctggaaaatattttttaaaaaatttgtacgtagagagaagataatcaggttcaagaatgctggatgggggatgggaacatgagggaatgggatggttgatttggaggagggacagaaagggggaaagcaatgaaaaagatattttaatagagggtgtgattatggtattagggagaaaccaggtgctagggaaattcccaggaatccataaggatgaccccagctaagactcctatcaatagagaagtgggtacctgaactggccttcccctataatcagattggtgattatcctactctccctgtcatcatagaaccctcatccagtaactgaagcagatgcagagatccacagccaagctccaggagtctagtcaaaaggagggaggagggattgtatgagcagggcgtggggtgaaggggttggggggtggtcaagatcactaggacagtgaaacccactgagacagctgatccgaggttgtgggaggtcagaaactccagactaacagctaggaaagctgcatgggacctatctaggccctctgtatgtgggagacagttgtgtagcttggtctttttgaggggtccctgacagtgggaccaggatctgtccctggtgcctgaactggattttttgaacccattccttatggtgggatgccttgctcagctttgatgcagggggaagggcttgggcctgcctcaacttaatgtgccaggctttgttgactccctannnnnnnnnnnnnnnnnnnnnnnnnnnnnnnnnnnnnnnnnnnnnnnnnnnnnnnnnnnnnnnnnnnnnnnnnnnnnnnnngggagggggaactgtggttagaatgattgccaagttccactagttaatactttgagttatgattttgtattatttgatgaggaggtacagactagtgcacgaatctgcgcaccaatgtacacacatacacagtacctgaagaatgtttcactaggaatctaatgaattttctctataccttgatcttgccaagaatacatttaactcattttgaaaatacctttaattttgcttttttttgggcctccagagcaatttttcttaaatcctcagtctctttctgtagttgttcattttcttcctgaagtttcagcctttgctcactgacaaagccacagttttccctttcagactccagtacagtttgaagtttttggatcatttcatgagaacgtgatatctcttctgaagaactttttgttttttttaaaacaaatgaaacagaacagaaaagatcaagacatgtacattttacaatttagacttctgttttctttattctgaatcacttcttttcacttcatcatggtgttgaatattgaccccaggctatatctacagctgtactctttttacttttgactaatgtggtttcaaaatgtacataaaaccaagtaaatgcatttaatttaacaatttaagtaagctgacctgatttagaaaatcaacatgaaatttcttctgattttttccctaatgttgagaattgttgcattaagagaacaatgtgaacccaatagtaaacagatgaaggagctgctaatcaaacttttacttaatgttaataccataggaaaacacaacagctggcacgcctttaatcccagctcttaggaggcagaggatctctgtgagttcgaggccagcctggtctacaggcttcaaaacaatacagagaaacactgtctcgaaaaacaaaacaaaaaaaagaaaaagaaaaacaaacaaacaaagtaaagtaaaatcaatctgcatatttcctgctatactccttagaactaggctttataaatttaaattctctaagcttattttagcacaggttaataagttattttctcagccatggattattagatcaggaattctctaaacatttatttttcaatcaatatactgctaattttcattcctattttctgaaatttctctttcaattccagataacaatcactctaaacatactctatttttcagttgtcacaggaaacatgtaaatgctactaatattgtgatggcttaatgagaaatagtgctgggcattcatgcttgctatcccagcacatggaaacctgaggcaggaggaatgcattgactttgaatgccagcctgggctacagattaagttccaagttagcatatgctatataataagacctagtcaaaataaaaatctaaagaactcaattattagttaaaagtaacttgaaaggagagaaattcttaatacgcacagtttttacctgatggcagttttattaccacaagccatagcttatggttctattccaaccctaacttccccaatgcttataattggctctgaacttccatttctgtcctgtttagacttttgcttttctagttcttcatattcttcttagttttaagttctatatgaaatcattcatttctgtaacatatggttttaattctatataaaatcattaattcctattaacacatgtagctatgttttcttttttttttaacattttttaaaatttagaaacaattgttttacatatcaagccctctgtttcctctccatcccatcctcccatgccacccaccaactcccccagcccaacccctacccactccccaagtatagtgaggccttctataggggacaatcaaagtctgtcacatcatttgggacaaggcccagggcctcctccgtgtatctaggctgaaacagtatcccttcatagggaatgggctcccaaagtccatttgtgaaatctggcactagggaaatgttcagagatccacaaagatgacaccaactaagaatctaagcagtagaggccacctttgatgccctttccttataatgagaatgatgactaccttaattgccatcctagagccttcatccaatagctgatggaagcagaagcagacacccatagctaagcactgagccatacttctagaaaccagttttagagaggaggagtgatgagcaaaggagtcaagactgtgctggaaaaacccacagaaacagctggcctgacctagtgagagtacaagaacttcagtcgtaaagctggggagtcaacgttggaccaaaccaaaccctctgaatgtgggtgccagttaggaggcctgggcaatctatgggacctctaacagtggaaccagtatttatccctagtgctactttttcttttcaaatagtaaagttccaaaaatcaacttcctgatgaaatagtatacacaggcattggtcataaaaggacattagtatcaaaagacattgcaacagaaacaaccatgtgtgtgcctcctaacagaagtgaataatgtaccaccaccagcagcagtagcagcagcaaaatagaagaaagagagaccacaagagattaatagagacttgagaaacagtgaagttagcatttttgaaactagaactgggctagagaatgcacactcaaaaggaatcttctgaatgatgtgatcataagcaagtatttatcaaggatagcctgaagatactggaatgctcccactgctttcccatgggttggtgagtacataagaaatgatgctggagagaagcacattgctgtggagaatttctggaagctttgggatctcccattgtatcaccaatgcaaaagaactatactaggaagaagtctactaatataaagatggatgagcctttgtcctatatggaacatttaaaattataaaaagatgattttacatgttagaaacagggaaaagctttctacccattgctcacaacccataagcagcacatgaaaaaacacacaatgaggatgaattcacactgggaagaattagtatggaaatatgcaaaatgggaaattgtttagataaattttcattccataattttaaaggactcacataaaaaaaaagcatcattatataatgtggtggtttggagaatggtctccataggctcatatgtttgaatacttatccttagttggtagaattatttgggaaggattaggagatataatagtcttaatgaggaggtatgtcactgggggtgagctttgagatttcaaaagcccaccaggcccagttagcgctctctctttgcctcctgcctgtggatcaggatgtagctgtcagctaccgttccagtgctatgcctgcctgcctgctaccaggcttcccatgattatgatcatgaactaaccccatgacactgtaaccccagttaaatgctttcttttataaattgccttggtcatggtgtctcttcacagcaatagaacaataactaagacactaatcagtataagtcttaagatgctgtcttctgtttatattgatggaaaaacttcatgcatgtcaagaatactagtgaagactttttaaaaaaatttatttttatttttttctccatttttaatttgaattagaaataagattgtcttatatgtcaatcccagttccctctctctcccttcctcccccctccaactaaaaccctacctatcacatatcctttctgctccccagggagggtgaggtcttccacagggggggtcttcagagtctgtcatatcctttgggatagggtctaggcccatccctgtttgtcttggctcagggagtatccctctatgtggaatggactcctaaagtccattcctatgctagggataagtactgatctactacaggaggacccatagatatcctcactgaaacccatgttcctggggtctggatcagtcctgtgctgttttcccagctatcagtctggggaccaagagctcccccttgtttaggtcagctgtttctgtgggtttcactagcctggtctggactgtgctcatcactagtccttctctgcaactggattccagttcagttcagtgattagttgtaggtgtctgttcctacttctaccagctgctggatgaggctataggatggcaatgtaagacagtcatcaatgtcattatcaggggagggcatttaaggtagccacttctctgttgcttagaatgttagttggtgtcatctttgtagatctctagatgtttccctagtacctgatttctctttaaacaaaaaatgtctccctctattatgtatctccattcttgttatcttctattcttcccccgactcaacctctctgctccctcatgtcctcctcatccctcctattctccccttctcattctcctagcttcttcccccctccccccatactcccaatttgctcaggagatcttatcactttccccttctccagaggaacatgtatgtctctcttagggtcctactaggaagactttttatatcaactacgtaccttaatatacaccaacagagagacaaactagcatttacaaatgtttaaccagactaattcaaagaaagagaatgctgtgtttttgttatcattcaattctagaaaattttctacttctgtcctgatttctttgatgactcatgaaacaatgttcaatttctatgagtttgtgtattctctgaagatctaattaataaaataaaatttaaaagggagacaatgtagcaaaacattattttaaggtgtgtgacttttgttcatgctgcatttgtttaactctgtgaagctatgattctttgtctttctaaagaaccttatggtctaataaaactctgaacggccaacaacaaggcaggagcaaggataggcaggcttggcagacagagtataaatagaaggagaaacaagaaagagagggagcaatgagagaacaaggggaggaggacatcaggggccagccacccagccaaccagggaataagcgtgaaagtaagatatacagaagacagagaaagataaaagccctgaggtcaaagatagatggaataatttaagttaggaaaagctggcaagaaacaagctaacctaaggttggacattcataattaacaataagcctccttttgtgatttgagtattgggtggtgggttcccccaaaagagacaagacaacaattaacaccaatgaaattcactagggcatattttgaaaaatctatgttctaatgaattggaaaaatctagaaaaatttctagaagtgacctaccaaaacttgtaagttagataactaaaatagatctgtagtgatgaaaatatatcagtgataaaaattttctcaattaaaaatacgactggattctatagaaatttaaagaaccaatacccatgttcctcaaactattgcataagatggaaagggaaagaatagtgctaaatttatgtacaaagtcaatatcaccctgatattaaaaccatataaagacataaccaaatgaaaaaaatttcttgctgaacgtctcaatgaaatacttgccaactgaatttgaccccacatcaaaaagaacattcaacatgaccaagtcagtttcattttaggaatgaaaagcatgattcaacacatttatctacaaatgtaatacattacaattgttgattcaaaaatggaaataatgtaatcatctcaaaagatgcagaaaggtcttcaacaaaggtcaacatcccttgataaaaacccaaagaaatcaggaattcaaggattatacctcaacataataaaagctactcatgataaaatagccaacattatagtaaatgggaacaggcttcatgcatttccttgaaaatcaggaatgagacaaagtgtcagctctttccacttttattcttcgtagtgattggagtcttaactatagcagtagagaaagtaataaaaaggatacagattgaaaaggaaggctctttgggagccctctccacatagagggatactctctcagccaagacacaagggggagggtctagtgcctgctccaaatgatatgacagactttgaagatcacccatggaaagcctcatggaatttctggggagcagatagtggcagggatagaaggctggtggggggcaagggtggaggggagggagactgaatggagattgacatgtaaaagaagattgtttctaatttaaattaaaaaaagaaaaaagaaaaggaaggcactaagttatttctatttgcagaggtataatgtcatacaaaagggaatctaacaacgcaacataaaacctcttagaaatgataaatactttcaacaaagcatcacgatataaacaccaatgtaagaaaccagtggctttcttaatataccaatatataacaaatactgagaaaaacataaggctagcaatctcttaaaaaaataactttaatatgcctaagcaaggaagccaaagaactctataatggaaaaaataaaactcttgaagaagctcaagattctagaagttaggaaaaaaattctcaggctcatggatcaaaagaattaacatagtaaaaatgactgaattacttcaaagtcacgtacatattcaatgcaatacccttaaaaattctactggcattcttcacagaattagaaaaaaagtgctaaaattcataaaagcacaaaagacactgaatagttaaagcaatcccaagcaaaaagaacaatgctagaagtatcacggtatcttatttcaagttatactgcatagtcacagaaacaaaaacagcaagtttcaaaaactttagagaaaaaaaccaaatcaaactaaaacataaaatatcctcagtaagtggtactggggaaactggatcacatgcagtagaaggaaactcaggtccctttctttcaatttgtacaaaaatcaattaaaagtaaattaaagactttaatgtttaaaattgttagggaagaacacataaaaaatacctcaagatatccgcatagcaaggactatctgaaaaatacagtaatagcttagaaaataataataataattgatctaagagattatatgacataaaataaactatacataaaatccaggcttcagattggtcaaaaacatcattgccaataatttatcagaggattataatctagaatacataaaagaatgtgaaaaatgaaacaaaaacactaagtaatacaaaactaatcatctgatcagtaaattggttaatagacctcaaaagaaatataaatggtcagtaaatatatagaaaaatattcaacacccttagccatcagggaaatgcaaactaaaatttctttgtgatttccatctcacccgaagaaaactaaacaaaagctggcaaggctgtgaggaaggaacggttcttagtcactgatggttagaatgtaaacttttcagccactatggaaatcagtatggaagcctccaaataaaaaacaaaaacacaaaaacaacaacaacaacaaaaaaaacagctatataatccaactaagaggcatgtacatatatatgtaggacacatacacatattctaaatcagcataccacagagatactagcacattctttgcatctctattcataatagccaaggatactgaaccagcctagttgttcaccaagagatgaatggataatgaaaaaaaatatataaatacagcagtatttcattcagcaataaagaaaaacaaaatcatatttgcaagatagttgatgcaactagaaatcaccgtgccaagccaagcaagccagaccaagataattttactgtatgtattattatgtatgtgggtgtgagagggaatagaattctgagggtgctaggaagatatataaggggagggagaggaaagcagaaacggggtactatttagtgggtgagaaggaaaccaaccatagggtaggaaggagacatagaggagggcagttgtgggaggggaacaaactacaagattatgactcatgagtatgaaaacgctatcactaaatgcattattttgtatgccagcttaaaaattaataaaaatagaaaatataaaaagaacatatttggctgtttttataagttctataaaaaggtaaataatttaccaaaactcatgtgaatgcttaaaatgttaacataggaattccactaaaaaacttacttaatttcaagttgttttattctattttctgcactctttagtcttagctgaagatcatcttttgtacgctctgcagcaagacatctttggtgcatttcttccagttttctgtaatcaccttcatcctgcttgccttcacggtaaatctgaggaagaggcttataaacattaccttataggaagaaattatctcaataaaaaattctgagaaataaagtcatgactatgtgttcatctctttctaaatgctatcaactgacagctaaaaaatttgaaataatgctcactataaactattcaactaatacagaaatgtaaaactgctgctgaaacttttaaaaaaatgcttttgctttcaaatgtcaatttaaaaacaactagtggtagggcggggtatgtagctcaatggtagagccccacaatgaataaagccgactttcaccctaaaacatcaaagaaagaagaaagtatagttatttagtgaatattcttcaagaaaatcttctattgaaatactcaagtacagtgtgttttattgtaactagtagatcttaaagttctagaactttgctctgagttacctgggaaacaacataggtaaaactggagttacctttgtcaggggcagttggtcagctacagcctgggtttcctcttatagtacggggcctaaatccctacaggccctgaggtccaggtcacattttcagacaaataattcatctaactgccctctcaagacgactggcttgccagtccacctgtgttgtccccactggtaagattgcaccaccctttctacataggtaggatagcagtatgtcagcactctttgctgggccactgagtgtcactgcagtcctacagcgctatggccttggctcactgctgtgtggttaatggagaactgattgctgtgtcttctaagtttagcactgcactaatatatgccatgtaatattaaaaaaatcatcctgaagcctgatatatagctggtaacattctaaatagaacttaaatgacatgaaggaaatctggaaagatctacctttagaagggtggtagccaaaaagtgtcacccttggaacacatgtacatatgcttatttctccaaatgaagccatattctaggttctattttgcaaattactgttttactacctgattttgtcattatttttgacaacatggatatatcacatactttgaatgtcatagagtttgcctttcaaagtcaaatcctaacttcactgcctagtgttttttaatactgtgtaaggtacttagtctttctatacaagttaccaatagcactttaaacatggtaagtgttcatatttgattgccttttgtttctcaaggcactttaaaacagtgggacattcactgctaatgaaaaagcatgcaacttttttttttttgcatgcaactattttttaagatgtagtttttacttcaaacatcgttggggtattttatctaattatattctttaaaaatatttcatcttatgtgtatgagtgttttgcatgtagggttgtgtatcttgttgagtgcccagtgcccacagaggtcaggacagggcactggatcccctggaactggagttacaaatgggtgtgaacctccacatggatgctaggaattgaactcagatctctggaagagcagccagtgcccttaaccactgatttctctagctccctaattactatattcttaaaaggtaaaattctggggcagggaaataactcagtaaactggttgttgtataaatactcacataaaagctgactatggaggcatgtgcctgtaatccctgctatggggtggcagaaattcatgttatttctgaggttgctggccaattatctagctgagatggtaagttatagttttattgaggcactatctcaacaaataaggtagaggaagattgaggaagacactcatgttaacctctggcctctgtacacacatggatacctgtaaacctgcgcacacacacacacacacacacacacacacacagagagagagagagagagagagagagagagagagagagagagagaaacacatacatacacaaaggtaaaattcatagcaatcctatgatattttggttgtatatatctattacaccccagtctaacctcaataaattggcataaagttaaaaaaaaaagacaaaatgaaaactactcttggaatgaggctagagcaataaatatagatatgtaagaaagttataccttgaactacaatgttcaaagaatatggatattctcagaaagaaatggatgtatatttaagaaaaggatggatatttaaatgagacttcagctatatttgagtaagcatattgcccagagtacttgcaaggctagtgtgagcacagcaggcaacaatgaagaagcctgcagttgccttcggacagctgtgcttccttcttaccttctcaagttcttcttccactgctcttttccctctgatggctcgatcgatttgaccttgcttttcatcacagtcctataaaatcaagtcataatgcaaacaaatgtatctggtgaaatattaatgtgagaaaaaaatggaaaagtaaaatggtttgtttataacaagagtattatagttacctcatcaactaagtaagatcacagagtacttatataagttacttacaactaaggagaattgctgggcatagggcatagtaattgtcagccttcaaaaatgacctatcctagaatttcagaaattgccttcggctcttcgacccctttttttgtggcagtgtgtgggggggatgttacaggttctcttttcatataatattaccaaattatcttgcaaaatgaacggacagtgtcacaatatccaaaggaaaacatctggcataaaaagtgtaaaattctaacaatttttctttacaaaatactcaacatccagggaaatctattagcatgagcataaaacattgaaacatttatacttaaaagactgtgtgtcaaacattttacttagtaatttaacaagtatatcaactaatcaatataataattttgccaaaatactaaaagcactacaatcaaccagtgagttcttcataattatttttctacatatttgagaacaagcagttttattgcgaacatgctttgttgacagtacaccacaaatattcatttttttcataattatataaaaggcctacctcagtgtttctaaaatttaaagcttttaaattatgatccagaaatgattactttgaaccctcttacaaacaaggtaggatttcttttgttgtttttgttaaaataggcctcagtttgtaggaaattcatttgtaatgtcttatacttattcatatacatgataagtacttatctataaaaggttttagtttttcggggttggggggagggatgtttttcagtttcactacatggcccaggctgccctcaaacttgaacttaagaccattctgtctctctgcctgctgagtggtaattttatgatgctaaactggtgacattttctttgttcataatgtcactcatgtaacttttatgtatatgtgtgctggttaatctttgtcaatttgacaaaactcaagtaatctggaaaggaggactcccaactgagaaactggcctatgggcatgtctatgggaacattttcttaatgaacagcaaactgtgggtagtgctaccccggggcacatggtcctaggctgtatatgaaagcaggtggagcaagtcataaagagccagtaagcagcatttctccatggtctcttcttaatttcctgcttctaggttcctccctcgagctcctgccttggctttcctggctgatggactataacctataagctaaaataaatacctttctcctcaagttgatttttcttttttgtcaatgttttatcacagcaatagaaagtaaactagaacactatgttaataacaaagttggatcatacttctagatccaggaagtggcctataaagaaaagaataactgtatttatctatgcccctacataagtcactatatttcactgacatcaagaagtatccaacagtatttggttaacctgagttaaaaatgggtaaaatgaaacagaaaagttgaaatatttatgattaacatactatccgactatttttattaaaacacactatgatattaaaatgaacaatataaatttttattaaaagctttgctcataatcactgatacacctgcttttggagataaattaactttacaagcatttgtgaaatatttctaaaatcatactttataaagggttagcaaatattaaaactgatagcacagaggtcacatttaccaacccctattcaaacaagatagagatcattaaaaaaaaaaaaaaagacagcctacaccttttcatttggagactcaaaaatacctacatatttcttagaactacctgtctttgctgtattccacaggttctcacaaaatggacttacatattcattagattttagaaagctttaaacttctcctatggcttcttcaatggtgtacttcttacatacctgcagttttctgtaattttccttgctactgatttctagttttataatcccatgacttggtaagtaataagaattacttcaattattttgtatttttaaagaaatgctgtttggactactttgtgatctattttagagaaaactccattggcttctgagaaagttgtgtgttccatagaagtgcattgcctagtttatagtgtagttcaacactgtagtttctttactggattttagtccagaacacttaacatcgatatgaaaaaattaaatgaagtcctccattattattcttatcaggaccaaattgtacatttgatgtcagtttatgaaactggaaatcctgtctcttcatgtattttataggcaatttcttccctttattaatatgacaaggccttctttatcccttcatgtaagttttgcttgaaggctatttaggtcagatttgattatggtgcatcctgcttattttttgattccactcactggttgtatcaattaccattctttcaagtttggtctgcctttgccagtaaggtgagtttcttaaagaaatttacagttagtctgcatcatttaattggagaattataacgatttcacttattattgattgacttgctgattcttgtaatttgttagttgttttctaactggtttgaccattactattttctttgtcctgattcacatgatgatcttttgtggtttcctgagttggacatggctaattctttcctatttacttgtttcctatttacaaatttcactctttgctgtgttttcatgagtaagggttttcctcctatgtgtacaggtctcattttagtatcttctgcaatactgtcttggtggtcatgaactgctttagtttgcccttgtcatgaaaagtctttattaaaaagtacatttgctagatacagtaaagctgtttgtcagttactcactttcagtgtctgaaacacactgttcaatgctttccctgacttccagtactcctgatgaaatgtcttctcatttagagtatcaattttacatagcctagaataatcttaaacttctggtctttctgtctcacctccagattgggtttacagatatgaaccctaatgctcagggttcccacatattaggcatatattgtacaaactaagctacacccccagcttctaagagggtatttctaatccatcctagaaacatccatatttttaaaaatatctttaaccagacagcaaaattttttccatagaatgtgatattagatgttatatatctttagaaaaatcactcaggtataaaagtgtttgatatatagcacaaaacacatttgttatataatgaaattgacaaaaatagtttttacaatatagtgagttttatatagatttgtttgttacaccattgttttaaggatccctagtcttagacagtcctcattctttttggaaaacaacaataatacttgtttttatacattaacaattaattaaagtgatctttgatggtggtaaagacacattttgtttttctatcacaaaatgcaagattttagataatagatgaaagagaacaagcaaaataagttacaattttatatgaccaataggccatgctgcatcctattggttttacaaagtgttcctacttcattcctacaattgaaactaagtaaacagagagtaaccatgcctggttgttacatccagggcctctacatgatgattaaagtctagtaacatacactacatgtatgtagccttttagaggatttaagtattattctgttgataattatttactttaaaatatactgtgcaaaaacacagtgctaggcaatagggaacactaaggatgatagaagagtcttactttggggtgctacaatctctttggaaatattttcctggaaagagcatggttgtacaaatggtcatgtgttgaacatacactaatgcacattatttattagaatgcacaaaatattgacaaattttatacagattaaaagtgatgtaaagactcagaaaagatgtatctttgtgaagttgtaagtatcttcctaattcctaaatatttttgtgttttgatcttgtgggaacagtcattatatttcatctcattaaattttcaagttaaatttaaatttccaatctcgtcacatgaaaattcttttcatcaccaccccaccttgtctactcattcttatttatttgtctgtagaaagctttactgtctttcttctttcctactgacatacatagcttttcttccttcctggtcttccagatcaacccaacatatggcaggagctgcagctggtttgtttagtagccctgtgttctgccaaggacaaatgaaatgtgatgaatgccacctgtcctactttatctaccataagccaaagacagcgtaaacatttctgtggatttttatttgtttactagcacctagcataggtcatgcttaaacatgtgtatggaaaaaatgaattcccaatgacctacatactggtctttaaagcaagtaatatttggagaaaaatactaaaacaaggttttctaacataccatctgaagggctgaaagttcttcccttaattgtgaaatcagtatttcatactgtttttttgtgctttcaacctgtgaattaagacataatttaggcaaagaataaaaaatgattactgacaaaaatttaccatggatttttttaaaaagcaatttttatggcataaaagaaaaataggcatataatatataaaatagctaagaatttgtaatgatctgtgtgtagtgagcatgcacacaggtggctgaggcagggagattttgttcattctgcctatactatatagtgagttcaaacctaccctaagttacacaacaagtcatatagatcagaccagaccacaggactgcacttgtagcattggttcagtatacataaggctccagaatctttagcattgtaaaataaagaatgatcatgagaactgaagacagaattggatgatgtatctaaaacaatggctataaagcatttttgtctcaggatccttttacactgtaaaaacagaacttctgtttataatggattcttttgattagcattttacaattattagaaataaaagcagaagctgggcattggtggtgcaaggctttaattacagcacttgggaggcagaggcaggcggatactgtgagttcgaggccagcctggtctccagagcgagtgccaggataggctccaaagctacacagagaaaccctgtcttgaaaaacaaaaacaaaaacaaaacaaacaaacaaaaagaaataaaagcagaaaaccctaaaagttttaccattaggtcctttaaataatgtaatcattaccttagactaagtattttttaataaaaataaatatattctcccaatctaaaattgctgtgtatttgctgaatgtctggctagacaggagacagctaggctcaaaggtgcttgtgcactccacctgttgtgctgacatatgtcacacagcctccagaagtagcactttgcacatgtgagagaacaagtgtgaaaagcaatgtctgcagactccctaactgcaaaatgtcagagagcaaggaatagaaaagaaaattacactggacatgtaattagtttttaaagcacttatgttctctatataggatcttttcacaatgtacactagacactaatgctaataaatgagtgttcaaggaaatctttgaataaacattgagatttttcagaaagagtatagctggtgtgcacagagcattttgaagaattaggatgtctaaggggaaaaaaaaagaattaggatgtcttcgataaacatttttcctaagagcttctaagggttttttttttttttttgatttttttgatttgaattagaaacaggattgttttacatgacaatcccagttcccttctccctcccgtcctcccctaccacccaccccccaactaaaacactacctatcacagatcctttctgctcccgctggatggtgaggccttccatagggtgtcatcagagtctatcgtatcctttgggatagggcctaggcccacccccatgtgtcttggctcagggagttcagggagtattcctctatgtggaatgggcttccaaagtccacacctatgctagggataagtactgaacacttatgggaaagtatgggacaggaggtcccatagatttctgaggtttcctcactgaaacccatgttcctggggtctggatcagtgccatgctggtatcccagctatcagtctgaggagcaagagtttccccttgttcaggttaactatttctgtgggtttcaccagcctggtctggacccatctgctcttcattcgtccttctctgcatctgggttccagttcatttcggtgattagttgtgggtgtctgcttctacttctatcagctgctggatgagggctatcaggtggcataaaagtcagtcatcaatttcaatatccgaggagggcatttaaggtagcctaccctctgttacttagcttgttagctggtgtcatctttgtagctcttcagacatttccctagtgtctgatttcaacgatgttcatagcagcactatttgtaacagccagaaactggaagcagcctagatgcccctcaactgaagaacggatagagaaaatgtggtacatttacaaaatggagtactacttcagtggaaaaaaaatagaatcttgaaatttgcaggaaaatggatagaacttgaagaaaccattctgagtgaggtaacccaatcacaaaaagacaaatatggcatgtactcactcatatgtggatttttagacatagagtaaaggattagcagcctacaatccacacggccagagaagccaaggaagaccctaagagagacatacatggtccctggagaagggaaagggtcacgatcccctgagcaaattgggagcacgggaagatgggggagggagctaggagaatgagaagggagaagaggaggtatgcagaggacatgagggagcagaaaggttgagttaggggaagaatagaagataacaagaatggagataccataatagagggagacattttaggtttacagagcttctaaggttttgtttttttttttttttaaaggactaagagaattattgataaggatataaaccaacaggaaacttatatgatctaaaaactttggaaactttcttgtataaaaggacctattttaactctaatgacccctatggaaggcctcaccctccctggggagcagaaaggatatgtgataggtagggtattagttggggttggtgatagtcaaggaggggagggagtgggaattgggattgacatacataacaatcttgtttctaattcaaattaaaaaatcaaaaaaggacctattttaatgatatagtgcaaactttcttagactagttttagtactgattgctatgtactttatttggttaattaatatgagttatctttttgaaagcctgccaaacagtgtatgtggcttaatttcaggctttactttgggctataatttacattgacatttcagataaaccaaggattaggacattaaggatcaatctattttgcttacaggtcagtaataatatgggcatagaggttgtgggatcatatgatcaggtactgttcagaattctttatgtgtatcatttcatttcttcttacaacagccccatgagttactacctccattactgatgagggattaatggctataatttccagttagtaaaggcttggtgcccagcaaggctctattgggagataatagaacctttataaaagtggggtctactgggaaatcttcagctgatctcaggcatgcacttgaaagggatcattgggatctcagcccccttctcacctatcttttatttcttggctatgtgatgagtggtttggctccatcatgtgcccttatcatgataggctgtcttgctgaaagtctgacaatggcaccaactaatcatggaccacagccactgaaactgggagccaaaacaaacctttcttgttatattaattctcctatatttttgttatagcaatggaaaactgactaccatagcaacagacagagaatttaagccatgaatgtttcatgtagcataaaaatttgagttcttaaaagtatagttatatctgcctgactccctacacaatttctaaactgtgttcttttcagcatcttatactgatacaaccaacttgaagctttacaacaaaagtattttataatgttgccaaactcagctgaatcaaaaaaagaatcttctgaagtattaacactgattatatcaccagtgatctatgacctaaggttcacaccgaattttttgcactgggatctgatgaaacccaatgtgagactgaggaagtttacaataggcagtaggactctgaaattgatagacagactaaagcctctcctatcctactcctctgtatttcccttcctccctccttccttctttctagtttcttgccatgaagcccagactggtcttgaacacactaacctgtgtcagccacccacgtgctaggattatatgctgtgtcactacacccagtttgtctttatacaaacatataaacatattctttacatagacattttatgaataataaggatagctggaaatgaaataccaattgactagaaactgattttctacttaacaaatagacaaggctaataatggccaaaattttagtttaaaactttttttttaaagttggaatatctgagagttaagccatttttttatttatgcaaagtttgacacatttttgttcaattttataactagaacagaaatatatgaaaacatgctcatttatatctaccatagtcaataaaatacttagagcaattgtcaattgtaataactagggaaatgactgctgacatggacattttcaaggaaaatactttcagctacagctgaataattagaaataaatatacataaatatttacagtgcttgttgttaaagaaacagaatattaataaatatatattctttatttatcaaaacattgcctgttctctgaaataacaaacagtgaaggaataaaaagatgtagacagtaaaggctctcataactctaatatttacttggtgatgtatatacatctttttgtttcatatataccacagataattattaaatgaaaacccaaagaaaaaactaaaaatagtgtaattttcattttcttttgctggaatttttccattttccttcaccatgagaatgtactactttttgaaacaatttttaaagttcaaatataaaaacctggcaacagtgtggaaccaacaggaggtagagaacaaataaagtgcttggcacacagaaagtgtttagtagatgttctgtgaatgaacacctggactagcaggggaaggctgggtttaaggaaaccaacaggcacatacatgaaaggaaaaatctgggtttaagagagtatgttcagttaagacacaacagactcagatatacacttgggctgcttacagatagggaggtaactagggttagagggcagacagagtgcctcagatatctacctgggctgcttatagggctagggagcacacaagagagtatcagagcagacagggaggttagtagggttagagggcagacaggagagcctcagatgtccacctgggatgcttacaaaaggaagatacctagagtttaggaggcagatactacagcctataaaggtatttagaataaatattgagactttaacactttttaaaaaatgcactgaaagtataaggttaacatgaatgaaacttcaatcagccttaaaaatcaatatacttaattgatcttaaaaatgcaattagaatggtagtacaggataaaatactttaataaaatatttttacaaagatcatgaaaacaacaaatatttattgttagccattaaaaaagtatgtaaagagtattgaacactatggtctaaaattaaaacattctcaagctaacatatagggaaagttctttttctttagttttttattttttatatatatgaattacaaacaagattgaattacacaacgatcttagttcccttctccctcccttcctcctctaccaccccaactaaaatcctacctatcatatgtcctttcttctaatctacacctgactcaaaatttctgcttcctcgtgacctctgcatccttccttttcttcccttctcactctcgtagcttcctccctcctcttcgaatgttctcaatttgctcaggggagggtgaccctttccccttctccaggggacaaaatttgtctcttttagggtcctccttgtttactagtttctctggcagtgtggaatgtagtctggtaatcccttactatatgtctaaaatccacatatgaatgaatacatatcatgtttgtctttttgtgattgggttacctcgctcagaatggtttcttcaagtatagggaaggttcttgcaggaagataagaataaaaaggctttagtctgactctgtcttaaatttgaatttttagtttgggaaattatctaacttcaattagtaataaagtacagtcacacatcatgttacaatggggtttgctctgaaatacattgtgactaccaaagagtgtatgtgcataagcctaggaggttgagggttcacaggctatgaaactatacagcatggtaatatagagaggtacacatagtggtatttgtttatcgaaatatattttagcctgaaagggtactgtaaaaataccaggtaacaggtgtttctgctctattatagtttcatgagatcactgtcatcatgcatagcttgttctcaaccaacatgaccttatatagcatgactaaagaatatttctaagggatatatttgaaatggcttcacaaaaaataaaggctaccatttagttgtttgaaagaaagcaaatatgttaacttcatgtttttaaattataaaaaaaaatcacttgaaattgtagttcactgaggagaaaaatattgagcacagaaaatacaggtaagaaaaaacccacctgaagttaaagactatgtagtacatttcactataccacagcagttcaatttaaaggaaagaaacagcagttttcaactacttacattaatagtttcacatagtgtctttgggagtgagcatacaaggttttaattttaaaatatttaagtagcatttagtcttagttaggacttaaattttatattttaagtataactaaaagctccttacttcttttcttgcttttatggcggcatcctgaataagctgggacattgttttcttcattttctctctgtcatcttctttttgcttctcttcaagcagaatcttcagaagataatcatggcacgttaaacatcacatttcactgggaaggtaatacgctctttgacagcagggtctcgttctagatttctggaatggctccattggaagatcttgcataaatcatgaatgataaggaatctcccagcattgcccaccttttcctaattaaatctttgctatttattccagccacagtttcccagcacttttctcatctccacaaatgaaagtctcagggtcattctgagcttttcttctttttatacacaaataaaaataagtaaatctttaaaaaaagaggaagagggaaattaatctaatagccataggctgcttctgaaggatttgttaacttagggctgaaatgagataggcaatggtgtcctgtcttctcttcactataagccatacaacatctgataagtatttatacaactgtgctttagagggtaaagacaaataactttgtcctgttcttaaattttctagctaacttgggtatttagaacagtttacaagcatatttctattttgggtagtattctacttttggtggtaccaaggataaaacctagggcttcacatgtggtaggcaaatattctgacaccgagctgtatcccaagacctactgcatacattttaactatcccaagagtgtagagacagaatttaagtcacagatggaagtactagctgaaaggtataagcatatcagcatttgtgcagtttggatttgaagaaataattattttccttttttctctctccccctctctctgtaggactcactgcccttaagtttattatccccctgctccacctcccttgagtactgggattgcaggcatgtggtacttcactcagcttcctttatactaggtttgtaaaatacaatttatactttttgaatttttagtatttctcttgaaaaatctaccacttcaagaaagaaacctaaataatacactttctttataccctgtgcatttcctactggagaactctgcatatatcacacagttcataaatgttggtacacattaatgctagaatgagttctataaaaaggagagtaacattttaaaaaagtatctgctttctgtcttctatagattatattcattaatagggaaacagtataagaaagaaagcatggtccagaatattacagaaatcacaatgattaagaggttgaaacaaaaaaaagcatgagttcaagaatccatctaatcttttgagctacatttaactttgtcaattaagcttctgcttgatgaagttactgaacaggtaaaaaggaatcaacacaactaggaggcatctgatggagcacagtctggtaaagaactatggcagtacagtgaaagaaggacagtgactcagagtatggggacacaacaagtctgatatttatgcactatgtttgaaaaatgattaccatgttagcttattttatgatattactcttgccatctataatatagcataactatttgataatgggaagtgtagactttgtttctacgcattctttctgtagctgatgatcccttcactgttagagcatgtgaggatcttatttatgtctgcatgctttgttacctgattctttttaaggttagcctcttctaagagttgcatgctatctctggctcttgaaatagcctcatatttctcattttctgattcattgcactttgcttgcagctctttgatttgcttttccaaatgtattttccctgttctcagtacgttggcttcttcaattgctatacacaatctagaaattaataaatacaatatgaaagttaaatattttaaaaggaagaaatgacatataaggtttagtaaacatcaccataaggtgatattatgcttgttatttttacatgcatttctcatttaaaccttgctatagttttataaaagtagattttacaatctccattttaaagaaaactatacccagaaagcttcagcttttgattaagaataataagagcagtagatctgagactgggacaagatattttgactgtaattgtgtgatgactcctacggtttttttggtgtttttttaattttgtgaaaatttcatagatatatacaatgtatcttcgtcatatggatcctccattgcctgtctccagttccacctctccttcctcaacatgttttccaactactccctaattttatgtatacattttttttctcccactaagtgtaacttgtgctaccaatatgggaatgtgtgagagatcatttgctgggatgtggtaaacctacccaaactattcccaaaagaaaagttaatcaggtgagcagtggtggtgcacgactttaatcccagcacttgggaggcagaggcaggcaatctctgtgagttcaagaccagcctggtctacaagagctagttccaggacaggttccaaagctacacagggaaatcctggcttgaaaaacacaaaacaaacaaacaagtaaaaagttaatcccctctctcagcagccatcaaatgccattagctcctctgttgtgggaactcattcagccaatagtctttgaggttctggctccttcggggcggagtctcagctgctacaagtggtagtagaggaaggaacggcagcatccagcacctaagggcagaagacctctactttgctttgtcatttgtgagtgattctccaataaatacctgacttccccttatccgggcctttgtggactctattacaattgtccattacactcttcagctaaggatgaggcactaagagtccctccctgttccacactagaattttaaagtagcctgatcttgcataggtctcaggcaggcaaccacagtggctatgagttcttgttatatccagaaggtaatctttaatggcacacttcctcatcctttagcactcagattctttctgtcctattttctgtgatgttatctaaccctgggagtaggggtagggtagggatgtatatatacttgttctacctactgctgagcattctcagctgagaagaagtagttattctcagaactttgaagagttgtgagtctgtgcagtaaccactgccttctgtagtaagaagcttctcttaccaaggttgagggcagcacaaacttgctggtatgtttccatacataaaaaattacaatcaattatttgacttacagccataaatacaatgtgaattcataggctgtacatatttaatctttcataggttactaatgacaactttcaagcccctcaatggaacattacagacctagacagaacaaccataacaaaatattctagtgtaaatgtttgtagtaaaacagcaacttaagacagagctatgtatattttaaaaagaagctcagctcttcaaagataatttaaaaagttattgctcaaaaaaaactcgagggaaattatctatattttcttattttttccctcatgtaagtacttagatctttcttaacatataattttattcaacttcattatccttttattttctaccttaaaatggaaagaaaatatgattctgaaactaacaatggctatgttgccttggggaaaggtaaaggcagtaaataacttccttgtatatgaaaaagatgcctcatagtttcctgaattattcattatgtgctttatatatgtatcttatgattttattagttcatgttttggacaggatatgctatgtatctaagtctggccttgaactcatgacctcttgtgttagtttctcattgcctatactgtttttctgacagggatctgcatctgatttcctgataaaagcatctgtattttcctccaccaaacaaacaccccaggatgtcagcagtcagcatctgaaacctgcccaatgctctcaccactggattcataaaatgccttcacttacgattttcttttgactacagaagtttatgtaaccatttacattttggaaggtgttatctagagtaatctgaatgtgttcccaggccatggccactcatgttcaggtcagaaaagactcactcttattccttttgatatgagagctgtgattgaggtcagcagttaaagtgtttagttcataagaaaatgtttcattggtaagatgtttaaggttttattccccagagaatatttagacagttattatgtgatttgaagagtctagctatccattgtcgatcactattatttttattctccatttcagatctttggtgcactactggtatgttatacctcctgtacctggccttcattctttccttatgtggataatgctggactttatttgagccctatgctcccaggaagacagagacttaagtagtacctccatatttattctacaatactttatttctttctaggaaagggcaaaccctgtgctcacatatgctaagatcctgtctgatgtctcctgtttatctgctcgtgtgaaatctcttcctaatttttaaaaagaattccccattatgaacaccctcactactgcaaagcttgatttgtcaggtcttttatagtgctaaagagtccttaaactacccaatcaaaccttggatgaaaaacaattgtgatttttttattttttaattatgtgtctatgtatatatcggtgtgtgtttatattatgtgtgtatgggtgaccgcaacagctagaagttggcattcaatctcctggagctggagttagaggtagttctaagctgtctaatgtgggtgctgggactaaatctgaatcctctgtaagagaaagaagagctcttaactgctcagtcaccacccctccagcctcaaacagaaaattttatgtttagatcactttcacattactgctcttaaagacagcatgttctcttttttgtatgtgtatacaatgagtattcaatgtatgttgaacaaatggttttacctgtgaacatagaagttgctttaaagagactgttaattttttttcttcagggtagaggagatggctcagtgattaagaacactggctgctcttgaagagaactgggtttgatttccagaacctatgcagtgcctcaaaactgtctgtaactccagtccaaggttatcccacactctctggcctctgtgggcaccaagcaggaaagcagtgcacagacacatatgtaggcataacacccatacatgcaaagttttttctccacataatgcatggaaattatacctagtctaaattcttttatagatctctcagcattatccatactttgtaggtacagtaataagagtcctaaaacaccttacacatacttcctgaagccatccaaaacataactattaaggtcaaaactgtttaccatttctctttttctctcttcccaatatagtcattattgattcctctagggatcatattcattttcttctgccaatttaggtattctgaatcttaaatggcaaaattcttagcataaacagtgtatttatagttaggaggggcaaacaattactgtcaattttattattatgaatatgtatgtcaacaataaaattttaatgaacaaaaattactcattttacaagtaggtaaaatcatcaaagttctcagaacgcacgcatgcacgcacgcacagacacacacacagacagacagacagacagacagacagacagacacacacacacacacacacacacacacacacacacacacacacacttattttagatctcacaccaattttaacttgggccactaaaatctttaaaggaatgttatggtaaaactatgaactatcaggatctgggaagatggatgtgtcaggaaagtactttctacagaaccatgaggacctgcgtttgatccatagtatctacataaaatagccaggtgtggcagtgtggtcttggaatttcagtgctatgaaggcaaggatagaaggaaccctggtgtttgtcagctatgggagctccaagttctatgggagactctggctcaaaaaataaggtagagaacgacagaggaagacacccgatgatgaactctgacctccacaaatatgtgctcatgtgtatatgcacctatataaacaagtataaaatatcagaaaatgagtatatatatcattatttactaaaatgaattttcagccatgacttaatagctcaagtattaaaataaggatataccactaacccaagaatactcaactgatatctaaaataagacatcattttagaactaatatcatgttaaaaactactcctgagttttcaaaaggaaacaatacatattctccctacttaataaggctttttgtttgtttggttggttggttgatttttggtttccgagacagggtttctctgtgaacctttggattggagcctggaactcactctgtagaccaggctggcctctgcctcttgagtgctgggaataaaggcatgctctaacactgcccagccctacttaaataaaatttaccacctaattttcaagttattttgctcaactggaacaaagaaaaggaactaagtgaaaagaaccagaaccattttgatacactgttgttctatagttcaatagtctatagaagagggtattgacatttgaaatctgtggggacccttttggtcgttacaatagtaagaggaacaactagaatttagtggttggtgcctgagagacaatctcataattgttggcacagtctcaaagtattaaaaaaaaaaaaaagtcccccacaaaaggtgaatggtattgttggttttttactcttatactcttagggggcctgccacccagatcccaaataaatatatgttgtcttattattacttatgtctgccttagcttggcttgtttctagtcagcttttcttaaattatcccatcttttacctcaggacttttacccttctgtaacgtcttactccatggcttgctgtgtagctgggcagctggctccaggatttctctccatctccctttcttgctcctccatcctttcttcccagacatctcttccttttattctctctgcctgcctatcccgcccatcttttttcctgcctatctattggcagttcagctctttattaaaccaatcacatgttttagttaggcaaagtaacacagcttcacagagttaaaagaatgcaacacatctgtgcatcattaaacaagtatttcacagcataaatgagtggaacacatcttaaaataacattccacaacagtgttgtcaaaaaatatcacaccattttataatggtcatgagggagagatcagtgattgcaaaatggatgagaaaggtaactggagattagagttcccaagaaagggaactttggaaagactggtagcttgacttctgtggaacaatgaagttaagcaacctatagggctttcctgtcacattaaacctaagaaacaagaataatctacagcattgagctcttaagagataatccttcttgcagggtttatggcctaagaacattatggaatacttaaaagctgacattttcattgccttctgttccaatgcttatttagaccttaaatgtattatttgttaaaacacaaaattatggaggatttggggaagtttcaaatttcctcagatactatgatttagaaattttaaatgctttttggaagggctttctgtttctaaaaataactagaaatacttcaagatctgtaagcttacatacatcaagaggactgaaaataaagatgtctttggtgttatagtattgtaatagaggtcataatggaaaccaggttaggaggcaaagtattttgccttacaaaccaagcacctggtaccaggaaaaaagcttatcatcttctttctaaggcacctacagctaaatctacacattcctatcttctggatttaatttcaacttgtctaagttgcagtactgttaggtaaggcagagacacactgggaatttctcccaggtttggacatattatacatacatacatgcatacacacatacatattttttcatatatatatatatatatatatatgtattttttttttctgagacagggtttctctgtgtagttttggagcctatcgtcaggttttataaatggcgcctctagcaaccatactagcccaaataccatggtgactaagagtttatttcttttcaaaaaagtattagatgaaatttggtgcaactgtttgttatctttcaaaattgtgacatgaatcaatacatgagtgtctagactttagatgtattacataaatgattttttttttcttttggtttttctgagacagggtttctctgtgtagctttggagtctatcctggaatctatagaccaggctgccttgaactcacagagatccacctgcctctgcctcctgagtgcttttttttttttttttctttttgacagtctctctacacaggagctattctgggactcactatgtacatcaaactagcctcaaactaacagagatcctcatgcctctaccttttgagtgctaggattaaggtatgagccaccacgcccaactaaatgatttttgaatgtatgttcaaagtataataataatattgtttttaaaataaggctcagattttaaacccatggttttagatttgatttagtatttataaaatacctattccaataaataattgaaaccctactgtacagtgcacatatgaagcatagagacacagttggaagcattaccttgactctaactgttttatacttgactgtaactgctgtaatcgtctatctgatgcttcctcttttccctgggcagatataatatcttcatcctaggaagtaaagaacccgaagcttacttgaaacatctcatactataatatacaagcaccattttacagcatgatgaacgcagcagagtacaaagttatgttactagcattctaatatgtaaagatatattttattaagtaaacacatctagtacaatgagtttgggagcaaacttcatcactaccatattagacaatcaagagttactgcaatgtttcacatgtttccactgcacatccagcaaaacaaggcaaaggttcctatgtggccactctgctgctataatatgttttaactatttcccatgatctattaagtgatacagggcatttcttacagagtgatgcttgcactatcaacaggttttatttacctcatttttctagaaaagcttcttgcctatcattgcttgccttcttttatagtaaacactctaaatgctatcatttcaatttattcatagttcttaacagtatctttgaaaagtttttttcccacacatgatcctcctacgtagcatggctagtctggaactcactgtatataccaggcagaccttcagtttggggcaatcttcctgattctgtttcccaagtgctgggattacaggtgtgctctaccatgtctggcttaacggaatctttaaaaaaaaaaaaatttcaacagtatttagacatactattctggatttaccacttgttgtggtttatttcctgaatctgagttgttacctagtaccatttccttttgcctcacaaacatctcaggaggaaatcaaagcagcaggcttggaggtacatgtctgtaatcccagcctttggagtttccagatggagtatcaggagctcagactccagtgagacattgggagcagcctgagcacagcctgagcttcaggagatcctacccaagaaactgaaccaaccaaacaataaataaacttccttctgaatgttctgaaatccaagtcttttgggcaaaaattctgtttatttatttggaatgtcttgctttcatttttcaaacacagctttactggatacagagcgcattgagagctgttgtcttcagcactttccacacgtcggaaatgttttctttctgccttcacaacttctcatgaagaactcagccatgattcttaccacccttcctctgtccagatcacctgtttctgttttcaatgtcttctttttaagactgtatatcagtgtcatcatgattctatagagatggttttgtttgtttgtcctctttaggggtcattattattcctgctaatgttttcctctgacttcaggttgttttctgcccttctccctcttttctgaagctctaattgcacctatattggaatggttcatactagtccaaaaacagatatttgaaactggttcttggacaaggaaatttctaatgttctctgctgaccctccttgcttatccagactttttgaatctatttttgggcctatctagtgaacttttttcccaattactacaaaagctctagaatttttattttaaaattattttcttgctctcagtggaaattctctaccttttccttcatttagactttatttactctagtttaaaaaataataaaaaaagaaaacaattctttgagcaatcttcttttttgagaagggttttataccgtagtacagactggtcttaaactcactatgtagccaaggatgattctgaactccctatcttcctgcctctacttcctaagtgttggggttataggtgtgcactgctacaccacactgaatttttttttgtagtgttatgtggagaccggagactgactctagaggttgctcattagtgctgtgacaaaaataattcaagaaaaaggaaggaaaggtttgtttcagcttttgtttgtggttctacgtccttcatagcaggtatgatatggaggcaagagcatgaagtagttagtcatatttcatccttagtcaagaaacagaaataaattccagtgtttagctaactttctccttattcactacagggatttagtccatgggacaatgctgttcacatttacaggggtctttctcacctctattaacccaacctaggaatcccctcagacactaaaaatgttttttcacatgagattctaaatcccatcatgttgagaagattgaccattacacccaatgctaggcaaacaaaagatcactgactacttaaatgtaaatgtaacaatcatttccaaatgctctttcttcaacatttaacaaccaggtccactgagagaaagcttttattggtaacatatcctatatttcccctaatcctttcccttaaagcatagataatactttcctgtctagtaatttttggttgaaaactggttgttctcaataacatattaaggactgattattacggactacagcaaggtgttattcaagtgggaaacaattttgcttattatgtgatctctgaaatttgttccacactgtacagaggttggtatctatgataagctcttgctgatttacacttttgttttcatataggcaggtcctatggagtgtaccgaacctacacaatctgaggggcaatccagatggggcagaggtagggttcactttctctgtgatttccttgttactagaaatttatttcctgtaatttccaactttggagtttgttgtcttatgccttaaataataatattctaaggctcaatttacactatttctacgatgtacttcaccattgtccttctacctgactacagcgacctttctcaggtttcagtctgctctccactctctgtatgtgaaacatggctaccagggttagggttagtaagaatatgaactgagagcaatggttacttttcctttgggtcctcttgtggccatcatgtccttttaaaatggccaatggcttttgtgggcctaaactttggttttgagtgcttaagccattataaagcttttttttgaagccataggtatgggaagtagaatgaagaaccaccaggtcagaaatccaaaacctagaaattctaatttcttttgttcctatttcagaatgttttccatgcctgaaaaaaaaattatttgtgggagagctcttatacctctccatactactctatcactataggaaatctataatcaacttttaagaactcaggaaataaggcttactagtaatagagatagtaactatcaaaagtagatttttttaataataatatccatctaaatctaaagcctgacatttcttcaatatctttctaaaagtcccctatgatgtatggaaagaatcagcctgatatgacaataaaaacttgaataagcaatataaactatggtattagatgtttattttccatctgaatagatgttaagcaaaacttggctgtaaactgtcttttaatgatctgtttatactatgatgtttaaattcactatgctaaaatcaatggaaatagagtcttcactaaaatattaccaatgctattaccttcttcagcatctgttcttgaagaccttcagtcactttagttaactcttccactttcgttactgcaactctcagatctaacttggcttgcctgaggaagaacataaattcatgtgttatgttagagaccataaagaatggaaagttcaaaatctaaatttagtaaaatcattactaatgtttatataactaaatattcatcccataggtaaattctgaatgatttccttaatgatattaaaacacgtataaaagtaagtaggaaaaatatagctaattatagaggggtataaagaggattactttatttatacaaattacatttaatgtccaaacaatcctgtgaatttagtgaagaaaaatttgatcatcttaaaacaagaatttcagtacagcaggaacttaactatgcttacactttcttcaatatacctaattagaaaactactgctgattggcctctgtgagaatgaacttaaagcttgaatgtctatcagcccctggagcagtgattataacactgggtaaaatctatatacccatagcaacttgcttttcttacctccagaaagattataatgttgatttttctatttgtttcactggttgctgaacaagtgaaagtacagtacattaaagtgcccagtaaacctgaaagcatctgttgggagaatctcagcatgccgagcactggcatcatgagcacagtgctgttactactagtgatgaaacccacctgaccaactgccgtgagaacaaaaactctcatattaatggacctttttcttattttgatctgattttaaataatcagtcaacttctaaattgtctgccaaattcatattcctcattgtttttatggttcaacatttatcaccattactacttccaaagactgatttccccaactcctcttgcttttttttttttttttttttttttttttttttttttttttttttttttttttttttttgagacaggttttaaagtcctgaagctggcctgaacaatgagcctcagccttctcttccctaaccccaggtgttgagataataggcaggtgccaccaggcccagatttaggcttaacattccaccttaagatttatttctagacaatctcaaatggcaaaaagacacttaaggaaatgcttaacatccttagtcatcagggaaatgcaaatcaaaaccttctgagattccatcttacaacaattagaatggctaaaatcaaaaacaccaatgacagcttgtgctagattggatgtggagaaagggaacacactttcacttctggtgggagtgcaaacttgtacagctgctgtgcaaatcagtatggtgatttctcagaaaattagggatcaacctacctgaaaaccctgtaataccactgttgggcatttacccaaaggaagcacattcacatttgctcaactatgttcataccaacattatttgtaatagccagctcttggaaacaccctagataactctcaactgaagaatggaaaaagaaaatgtggtatatttacacaatggattactactcagtggaaagaaacaatggcatcctaaaattcaaaggcaaatggacccaaaaccagaaagacaaatatagtatgtatttactcataagtggatgtcagacataaagcaaaagatatccagcctacaatccataacttcagagagagaggcttgaaccctattccagaaacagatggaagcagatgcagaaaaccacaactaaccaatgggtcaagctcccggagtacaattgaagtaagggaggagtgaaaatatgaactaagaagtcaagcccatgatggggaaacccacagaatcagccggcctgagctagtgagatcactgactcaggtctgacaaatggggaacctgcataagaccaaattagattcccttaatataggtgaaaatggtgtgaataggacaatatatgaagtcaatggcagtaggtccaagacctaacactaatgcacaaactgacttagtggagcccattctatatagagagataccttgcccagcctagactcagggatgtggaggtggagagttgccttggtcctgcctcaactagatgatgggacagacttagtagacttcctgtgggaggccttaccctctccatggagcaaatgggaggagcgggggaatggagggagtgggagaagagaagggagtgggaactgggattgaaacgtaaaaaataaatgatttaaaaatttatttctagatttcctagtcaaaatgtaaagttttattttcattatttttgaataaaattctatattgctctttatggataaaacgtcagtattgtcagccccaaagtctcatctcctgccagttcctcccatgtactctgtttaagagagaacatacaattcatgtgttccctgagcacactcttaacttttccatttttattgtacaagtctctccctcttttcgaatttttcaacagttaccaaattaaaagttgccccttgtcaagtcctcattggttttgtcttcaaaatatcccaagctacaatccttatactacttaattccttgcacattaacagatcacactgcattacaattaaaactatagggatttgtccttgtggaattatgatttcatagaagaggggtacaacttgaaggcagtgacaacactttattaattttaacccctttggagacaagtaagagcatgataaatgagtgcaaaggagaagatgaaaacatcagctattagcaccactgaaccttcatgttttcttgtatggacaatcctagagtagtgatttgtggaagctttaagaaaacacactcacacacacacacacacacacacacacacacacacacacacacacacacacgcacttcacacactttctttaaaacaggtctactactagtatagaagtattgtacctctactattaggttggacagggtggccagtgagtatcgggatccacctgtctctatcttcccagcactgggatcatgaacatatagcaccctgcctagctcttttataaggctttcagggattgaactcaggttgttctcatgcttgcatgggaagactttactaactgagcaatcttcttagccccctaaaataagagaaatcatttccacccagaatcagagtatctgctattgaaaaaacaaagtttagataaggaaaggtggtacacaaatataatcctagcacacaagaggctgagactggaagagaacaaatttcatgccagcctggactacctaatgagctctaggtcaacttggaactagataacaagaccctggcaaaacaaaacaataagaaactcaaataaaccattgacctaataatttaagttttgaggacaaaaagtaaatcaacactagatatatgtatttgggaaacattattattgatattaatgaacttaggtagggtacatgtaaggaaagggaagaaatgagtaaaaggaatgaaatttatgaaatatctattttcagtgggtcggatgaggaaatcaggaagctgagaaggggccccaaagtcatagaagaaaatcagaaacaaatacaaaatagaagaggatattccacggtaagtaaaataaagagattcttcaaggcaatttcagaggacgggaaaggaaaaatacaacctgagcaattatcagcaagttctgacataggattcaaagaaccccacaaaagagaactaacacttcatacaaggcatagttacagaaatgatgagaagttactttcctacctagacagactggatgctgaaggagaatggatgttctttaagatagtgttagaacccactgcacactgaggagggcatttttgctctcctagagatgaggaaactgaacttcatgcacctagcaacctgtcaaaaccctccatcaataaacagctgctagtatgaatgtacctgttctctcacaacacaaatgctaaaatcccatgaaagtacaacattcagataacctcatgtgatggtattaggaggtgtagtgttttggggggaggtaatgatatcatgattgtggactcaaaaatgggatcagcagtcctataagaggcatgaagggggctgcttgccccttccattatgtgaagactcaccaataaggtgcaatttgtaaaccaaagccctcactggacatggaacttgctggtgtcttattcttagctttgtcattctcttgaactctaaagaaataactttatggtgtttccaacctatttctctacagtattttgttaaacagcaaaaatggactaaggcaatacaggactagaacgtaaaagtagggctaatcacacagtctttgcttctcacacaacaactcatatgaaagtacaacctaaaaaggtgcaaagaacagaatatttgcaaaagacagttataaatatcagtaaacattcttaaataaatagttttgttttgaccaacggctgaaacaagaaatcttaatattaaatagtttctgccaaggtctactcatgatacatgtgctctacaagtaaaatggggatattctttgttcttcaaagagtaagagaaacaaaattttaaaaataacatataatgtaatcttcccttagataacattaaggttaaataaaccttgcaggaaaatgtcaggaaggccctatcctcatcctagaacctgttttcgttttctatgctcagaaagctagctgccaacacataaggaactgtctggcaattctatgactaagcacatctgctcaaggctgtttcttacatgggaaggattccaagagacaccatgaatcaaaactagtggcacatgaattccagatttccacagcattttataatagaagacacaatattattcaaattgaaacatgaaacatctgagaaaaatctgttatctcagttaaaataaaaccattacctggcaaaagtacattttaaaaataagcagtatataagttactggcacatacttttggagaaaaaagtattcatctgtaaaaatgtcttgaacacaatgaatatacataaacttcaatttacataatttatctttcacattcaatatgatagcatgagatcaagaactgcatttgtattacatcagttcttacgtttttcaataaaaccattacttataatttcatgatcagtcttaaagtgtcttggattttacttaaatacagaactaaacatttacctttatcactcattgaaattttgagattacgggtaataaaacagacataaagggaaatacaacttaaaggctggatctgcaataaaaaacacataatgtatctgatacaatgatacaatacttctgtttactatatgaaaatgattgatcagatgtgctcatttggagaccacattactaagtagtcacccattcctgaatagctgaataaagagtataatacaaaaattttccaaataatgacagcctaagaaagcagttgtgcctctcaaagattgaagagcaagggacatgaatagaaaaccatataaatagattattttactgttttaataaaggataatttatttaatttgataatcacttaaaatattttcttaacatctttcatggaccctacaggatattgagatgaaaatgtacaaagttaatctacagattcaatgcaatccccactcaaaatcccagcacaattcttcacagactttgatagaacaatactcaactttatatggaaaaacaaaacacccaggataactaaaacaactctatataataaaggaacttccagaggcatcaccatccctgacttcaagctctgaaaacagcttggtactggcacaaaaatagataggtaaaccaatggaatccactgaaaacccctgttattaacccacacaactatgaaaacctgattttttttgacaaagaaactaaaattatacaatggaaaaaagaaagcatcttcaacaaatggtgctggcacaagtggatgctggcatgtacaagattgcagatagatccatatctatcgccatgcacaaaacttaagtccaaatggatcaaagacctcaacataaacccagccacactgaacctcctagaagagacagtgggaggtacctttgaactaattggtacaggagaccaattcctgaccataacaccagtagcatagacactgagatctactattaataaatgggacctcctgaaaccaaaaaagcttctgtaaggcaaaggacacagtcagtaagacaaaatgacagcccacagaatgggaaaagatcttcaccaaccccatatctgacagggggctgatatctaaaatatacaatgaactcaagaagctagccaccaaaacaccaaatattgcaattaaaaatgtggggtgcagaactaaatagagaattctcaacagaggaaccctaaatggctgaaagacacttaagaaagtgctcaaaatccttactcatcagggaatgcaaatcaaaacaaatctgagataccatcttataccaattagaatggctaaaatcaaaacaccaacaacagtttatgctggagaggatgtggagaaaggggaatgcttctccattgcttgtgggagtgcaaacttgtacagccactttggaaatcagtatggtggttccttaggaaaatgggaatcagccatctgattgggtatattaaatagtcatgatggtcaaaatatcatagtaaaccagatgtgatagtacacacctattacacactcatacaacaaggacatctgttcaactatgttcacagcagcattatttatagtagccagaacctggaagcaaactagatgtccctcaactgaagaatggatggagaaaatgtggtacatttacacaatggagtactactcagcagaaaaaaacaatggaatcttgaaattcacaggaaaatggatggaactagaagaaaccattctgagtgaggtaacccagtaacagaaagacaaacatggcaagtacttactcatgtatggaaattagacatagagcaaaggattaccagcctacaattcacactgccagagaagctaggaaacaaggagaaccctaagagagacatacatggtcgtctggagaagggaaaagggacaagatctcctgagcaaattaggagcacagcaggaagggagagggagttaggagaaagagaaggggagaagaggtggggagaggagtacatgagggaacaggtagatggaattgggggaagaatagagaagagcaagaaaagagataccataatagagggagccattataggttagagagaaatctggcactagggaaatgtccagagattcacaaggatgaccccaactaacaatctaagcagtggttgagaggctaccttaaatgcccttcccctataatgagattgataactaccttatttgtcaccctagagccttcatccagtagttgatggaagcagaagcagacacccacagctaaacattgaactgaactcctggaatccagttgcagagagggaggagtgataagcaaagaggtgaagaccaggctggaaaaaccacagaaacagctgacctgaacaagggggagctcatggaacccagactgatagctgggaaaccaacataggaccaacctagaccccttcaacgtgggtgccagttagacggcttgggcaatctatagggcctctggtagtagatcagtgtttatccctagtatacaaatgcactttgggagcccattgcacatagagggacactctctcaggctagacccatgggggagggcatatgccctgctccaaatgatatgacagactttgaagatccccattgaaggcctcatccctggggagcagaaaggggttgggatagggggctggtggggggcagagatgagggagaaggaactgggattgacatgtaaaacaagcttgtttctaatttaaatacaagaaaaagggaaaaatctttcaaaaataaaatttgaccatatcatttcatgtcagttactgctcagaacggcatcaagtcttctgctatctgacctcagaccattccacatttcaacttctgaactatttttgttaagtttcagaggttaatatgaacccacctgccagtgtttcaggccatctttaaaggaaatcctgtataccaataaaacccaccattcctaaaagatacactcaaatgactatatatgtatatacatatatatctacacacacaaacacacacacacacacacacacacacacacacacggtatcactgttagaactcactatgttgtccaggctggtttcaaactcagagatctatttgtctgcctgtccagtgctgcaattaaaggtgtgtgccactatacttggctccctttcttttaaagacacctccaaaattcagaatttgagcctactatatttgcttatagtacatatgggtatatgtactataagcaaatataatgaaatgaaaaagcacctacaaagaaataatttaaaatttcaattaaatgagagagtgctaagtagatccacaaggatcaaagaataaaaatctggtgtaataaaggagaacaccttcctggagaaaacaagtgtaaccacagagagtacaaattttctgagaaatagaataatggtgaaaaggcaaaaaggaagcaggaggcttttaggaaacagcaaagtgacacctgtggcactttacaccaaagggttaaggagggccaggtgaacgacaattgtgaaaaaactgctatggcagagtatcaccaaaactctcaaaaaggaaaacaaaagaagctttaattatatagtcacatgattgcagtttttggaatcacattatcagacaacaaatgaaactatgtttcagtgtaagtacaaatgtgtttaaagaatttctagtttactttttcttggcatggtaatatagaacatttcaaaactgcagtgtggtaatgtcaatatgcccatcattcagaatctgtcaaacttgaaagcaacatcctttccctcaaagaagcatctgcttatccttatgttccttcaaatctgtggcaggaaaagcatgcatagttttatgtatacaactctgaattgcttaatgttgaactatagaataccgttggtaaatattatgctaaaattgcttacggacagcgcaacattcaagaccttttaggcttcagaaaaccacaactagcattatcattctcaactcatttaatctgaagtcatagtctttataccaaatgtacaaaaaaacaaataaattttctacacagatgtcaaaaatcaacatacccactcatcatcctttcttttccaatcaactctcattcttgattctttatggctgtgaatactgtcagagagccaggcttagcaactcactaagattagcaatgaaaagataggagttccaacttggcctttccttgagtctgttgggaaaccctgtgtgagacagttcaagcctttgatttggtttagtttctttataatattaagaagttagaaaaatggccactaagatgctgtctgccagttcaaggagtaatagtttaccctgacctttagaccctagttctcttttccttttcaacatggatattccataaccacattatttctcagtgaatgactgcaggtcattatgaaccaatttcctcactcaactttctttcaggatctatctctgcattcttaaaggagtgcactaccactatccggctatcgctgcattctaggttatcctactatagataatgctccttgcaatcttttctggaccttgaattcagagttaagcacactgttagatgactcattgttttcaacagacatgacaatgctttcagttgtgtttggtgctgcctctttgttttgtatgttcatgttaagctgtgatacatgttgctagtgcatgtttttatactaaacatccctatctgtgtaatataaactttgattttagatctatgttttggcatttcattatctatctatatgaaatatatcaatgcttgttgttgatgccttattttctatacacattattaccacatattacccactattcccttggtgatgaacaagtaggctgcctgctgctgggggatattcgatcacactgtgaaaccaagtttgcatttgcattaattaaataaaattaactttaggtccagaggttgagttagcaaatagctgacagaaagttatcatagggtatcacagggcatttcgaagagttagagagatgtacaggaagtagtcgggaggggtttggagtggcatggttctctttggaagatgccagcaagaagagaaggttagctagttgttactttgcctcgatgaactagcaggttttcaccctaacctttgattctccagtcttctttacaaacagagcaagtagaaatttagttaaagctacctttagtgagtggcagtgacagggctagtgcctgcatgaaaagacttcccatcaagctgcacctgctaccagagaagcaggcaggtaactgcagaaacacaattgctgactaaaatagcagtaggttgaggtgcagccaatgcgtttaagttaaaacagcagcctgcacttcccaacttctacaaatagccacagtccacagaaacaatgaccacctaagttagggaatagaattgctggatatatttttattttagaaacaaatatatgtaatacatactttgttcttgtactatatatactaaatatggatacctatctctatagctaaaatgtctataatgaatatagataattatttaaaaattgttgaattaaatataaatgtataatatcctaaaagacttcattatgatattttactttgaatctatgcatatgtacatgcatgtgtatacagagagagagagaaagaaagaggtactgactttttgagacaggggttacatgagctagcctcaaataattctcctgtctcgacttactaagtgccacgattacaagtgtgtgccatcatgtcaagcttctatcttattttttgacataattttttttttctaagacaaggttttctggaacttgctctgtaaaccagactggccttgaactcagagatctgcctgcctctgcctcccaagtgttgggactagaggcttttgcccaagactgtcaggcccaacatcaatttttgagcacggagattaggatctctaatccaaaaatatgaaatctgaaacactaaaaaatttgaaagagccctccaccactcagaggcaaggtgagtgtgggccccagtctcaagcccgactcaaacttgccctctttgggatctcctggattggggactacaagtaggttgaattacctcaggtggataaagccatccagagtcttctgacattgcagtgctagtcccacctccgcccactgggagaaggagtatctcagacgccggtgaacacatcatgagacacatcagagtattggacctgcttgcacccacctgaagacaaccttggacccgtacccaccaggagaggaagagacaccacctgcacacactggaagaagggatatgaagatgacaatatatgaatacattcaacaacagaaaaacaaatatgatgctaccagaggctagggattctacaccagcaagatctgcacatcccaacacagatgaagcagaagagaacaaccttaaacacaacttcataaagatgatagagaccctagaagaggaaatgagaaaatcatttaaagaaatggaagataaaacaaagaaaaaaattcaagaaatggaggaaaagacaaatcaaaaattgaaacaaacaattcaaacagtgcaaggtttgaaagttgaaataaaaacaataaaaactctgagggaatgctgtaattagaaaatctgggtaaacaatcaggactacagatgcaagcataacaaacagaatacaagagatagaagagagaatcttaggcattgaagatacactgggagaaatagactcatcatccatagaaaatctgaagtccaacaaattcctaacaaaaaatatccaggaaatatgggacaccatgaaaaggccaaacctaagaataacaggtatagaagaaagtgaagaaacacaactcaaaggtgcagaaaacatatttaacaaaatcataggagaaaactttaccaacctaaagaaagacatgtcaatgaaaatacaagaagcttacaagacacaaatagagtaaaccacaagaaagtcaatacataataaccaaaacactaaacatacagaataaagaaagaatattaagagcagcaaaggaaaaaaatcaaagtagcttacaaaggtaaacctatcagaattacacctgacttcgccaaggaaactcttaaagccaaaaggtcctggatagatactctacaaacacgaagagactacgaatgacagccaaaactactctactcagcaaagctttcaatcactatagatggagaaaaccagatttaagcaatacatatccactaatccagccctagagaaagtcctggaaggaaaactccaacctaaagaagttaactacactcacaaaaacataggcaatagataattccactttaccaaaagccaaaagaaaaagcagggtaaatccacacacaataccaccaccaaatccaaaataaacaaggattaacactcaatggtcctcaatttccctcaatattaatggtcttaattcacctataaaaagacacaggctaacagaatggatacgaagacagaatccatccctctgatgcatacaagaaacacacaccaacttcaaagacagacattacctcaaagtaaagggttgggataaaatttcccaatcaaatggacctcccccaaaaaaggtggtgtagctatccaaataagactgcaaactaaagtcaatcaaacaagatgaagatggtcattacatattcatcaaaggaaaaatccatcaggatgcactctcaattctgaacatctatgccccaaatacaaagacagccacattcataaagaaacattaaaaaaatcaaatcacacataaaacctcacacacttatagagggagacttcaacaccccactctcaccaatagacaggaacacatgacagaaacttaacaaagagtcaaaagaactgacagaagttatgacccaattgggtttaacagacatttatagaacattttatccaaatacaaaagaatgtatcttcttttcagcgccacatggaactatctctaaaatggaccacatacttggcaacatagcaaacctcaacagatacaaaaaaaaaaaaaaaaaaaaaaaaaaaaaaaaaaggaataaccctctgtatcttatcagaacaccatgctttaaatgtagaattcaacaacaacacaaattacagaaaccctacaaactcatgaaaattgaataatgcccaattgcaccattcctgggtcgaggaaaaaataaaaaataaagacttcctagaatttaaagagaatgaagacacaacataccagaacttatgggatactttgaaagcagtgctaagaggaacgttcatagtactaagtgcccacatgaagaaactggagaatagtcacactagagaattgacagaataactgaaagctttagaacaagaagcaaactcaccatggaggagtagacaccaggaaataatcaaactgagggctgaaatcaattaagtaggaactaggaaaacattacaaagaattaatgaaacaaagagttggttttttgagaaaaatcaacaagatagacaaacttctatccaaactaactaaaaggcagagagagagagcacgctaattaacaaaatcagaaatgaaatgcgggatataacagcagacattgaggaaatccagagaatcagcaggatatactttgaaaacctgtactccacaaaatttgaaaatctaaaggaaatggataattttctggatagacatcacttaccaaaattaaatcaagaacagataagcaagttaaactgacctataacccccaatgaaatagaaacattcaccaaaagcctcccacaaaaaaaaaaaaaaaaaaaaaagccagggccagatggcttcactgcacaattctaccaagaattcaaagacgaactaataccactactcctcaaattatttcacaaaatagaaacagaagggacatttttaccaggctacaattaacttgatacccaagccacacaaagacacaactaaagaagagacctatagaccaatgtccctcatgaacattgatgaaaaaatactcaacaaagtattggcaaatcaaatccaagaacacatcagaaaaatcatccaccatgataaacaaggcttcatcccagggatgcaaagatggttcaacattcaaaaatccatcaatgtaatccaccacataaacaaactgaaaaagaaaaaccacatgatcatctcactagatgctgaaaaagcctttgacaaaatccaacaccccttcatactaaagatcttagaaagaaaagaaataacaggaacatatctaaacatgataaaagcaatacacaccaaaccaacagccaacatcaaactaaatggagagaaactcaaagcttttcctctaaaatcaggaacaagacaaggctgtccactctctccatatcctcaatactgtacttgaagttctagctacaagccacagtcctgaaaacggcttagtattggcacaaaaatagatagacaaatggaatcaaattgaaaaccctgacattaacccatacacctatgaacaactgatttttgacaaagtagttatatttatacaatggaaaaaagaaagcatcttcaataaatggtgctggcacaactggatgctggcatgtacaagattgaagatagatccatatctattgccatgcacaaaactcaaatccaaatagatcaaagacctcaacataaacccagccacactgaacctcctagaagagacagtgggaggtacctttgaactaattggtacaggagaccaattcctgaacataacaccagtagcacagacactgagatctactattaataaatgggacctcctgaaaccaaaaagcttctgtaaggcaaaggacacagtcagtaagacaaaatgacagcccacagaatgggaaaagatcttcaccaaccccatatctgacagggggctgatatctaaaatatacaatgaactcaagaagctagtcaccaaaacaccaaacaatgaaattaaaaagtggggtgcagaactaaatagagaattctcaatagaggaatctaaaatggctgaaagacacttaagaaagtgctcaaaatcccaagccatcagggaaatgcaaatcaaaacaactctttacaccggccaaaatggttaaaatcaaaaccaccaatgacagtcaatgctggagaggatgtggagaaaaaggaacactcctccattgctggtaggagtgcaaagttttaagaccactttggaaatcagtatggcagttttgtaggaaaatgggaatcagtctaccacaagttccagcaattcctctcttcggcatatacccaaagaatgtacattcatacaacaaggacatatattcaactatgttcatagcagtgctttttgtaatatagccagaacctggaagcaacctagatgcccttcaactgaagaatggatagagaaaacgtggtacatttacacaatggagtagtactcagcagaaaaaagcaaaggaatcttgaaatctgcagtcaaatggatggaactcatcctgagtgaggtaacccagtcacataaagacaaacatggtatgtactcactcatatatgaattttagatatagtacaaaggattatcagcctacaatactcatcaccaaagtaactaggaaacaagaaggactctaagagaggagtgcatggatcccagagaagggaaaggcgcaggatctcctgagctaattgggagcatgaggttagtggagagacagctgggagaatgacagcgggagaagaggaggggagaggaggaaatgggggagcaggaaggttgagttggaggaagaacagaggagagcaggaggagagataccataacagagggagccattataggtttgaggagagatctggcaccagggagattcccagggaactacaagaatgacaccaactgacaatctaggcaatggtggagaacctaccctaaatgcccttaccctataatgagactgatgactgccttacatgccatcctagaggccttatccagtggctgacggaaacagaagcagacacccacagctaaatactgaactgaactctgaacccagttgcagagagggaggagtgaagagcaaagaggtccggagcaggctggtgaagcccacggagacagctgacctgaacaagggggagcacatggaccccagactgatgtctgggaagccagcatgggactgatccagacccctgaatgtggatgtcaatgaagaggcctcagcactctatggggccccagtagtgaatcagtatttaccctgggtgtaagaagggactttgggagcccatcccacatggaggaatgctctcttaacctggacacatcgggtagggtctaggccctgccaaagatggtatgacagactttgggtaacccccatggagggatttaccttccctgggaacagaggggggacgaggtggggggtcaagagagagtgagagggaaagtttctaatttgaactaataaaaaataatgtaaaaaaaaattgctcgacatccttacccatcagggaaatgcaaatcaaaataactctaagatactaccttactcctgtcagaatggccgaaatcaaaaacatcaacattttatgctggagaggaagtggagaaagcagaacattcctccactgctggtgggagtgccaacttgtacagccactttggaaatcagtatggcgattcctcagaaaaatgggaatcagtctaccataagattcagcaattccactctcaggcatatacgtaaaagaagaacattcaaacaataagtacatctcttcaactatgttcatagcagtattatttgtaatagccagaacctggaagcaatctagatgcccctcaactgaagaatggatagagaaaatgtggtacatttatacaatggagtactactcagcgggaaaacaaaacaaaacaaaacaacaacaacaacaaaaaagaaaaaaaaacaaagaaacaatggaatcttgcagctgtcaggcaaatggatggaactagaagacaccatcctgagtgaggtaacccagtcacaaaaggacaaacatggtatgtactcattcatttatggacattagacatagaacaaaggattacaagacaataagccctacttccagaggagctaagaaacaaagaggaccctgtgagaagcatacatggagaagggaaaagggacaagatctcctgagcaaactgtgagcactgcaagaggggagagggtgttaggagaaagagaaagaagaaatccccactttctcaggtaaggtaaaggccacaaaccctggcaattttcctcttctcccctctccagtgctggtgtgtagtcatgcactgctatgcctagatttttacattctgctagggatctgaatttaggcccacatgcttgcaaattttacccactgaatcatctccccagtccctagcatttaaatttttgaatgttgttcctaactgcttactgattcattttgttgtgcttgtttaaaaatctttgtcaaaaagaaggcaaaacaaactaaagaaaaaaggatagacaatttatatcaatgaaggattcaagtacagcaaaaaaacatatgcactcaacattaccacaccaaatatcataatgaacactactggccataaaggcccaaacagacttcaaaacaacactaataggtgacctgactaatattttattctcatcaataactaagtcatccagataaaatctatcagcaaagaaactacagagttaaattatagatcaaatggagttaataaacacccacaaactattctatcccaaagctgctaagtacacaatcttgaatgattagtgtgtcactaaaggaataaggaaggaaataaaacaattcttagcatcaaaggagaatgaaagcacaacatactagaatctgagagaaacagaaaaaagtggttataatagaaaactttgtagtcacaaattcctactttaagaaaaatcagatatctcatataaataatctaataaaactcaaggtcctaaaaggtttatcttcaaatcagcacaaggaaacaaaggataaagtccagagtttaaattcatgaaatggaaaactaaaagaacaatacaaaggattaatcaaacaaagagtgggtcctttgaaaaggacaaataaactgacaaatgtaatccttagcaaaactactcaaaagacctgtcaataaaattagagatgaaagggggggtttacattatagcagttttcaatgagttctagataactaacagtgaatattctgatcatacatacatacatacatacatacatacatacatacatacacacacacacacacacacacactcttggtttttctctgtatagctttggagcctgtcctggaactagctcttgtagaccaggttggtctccaactcacagagatacacctgcctctacctcctgagtaccaggattaaaggcgtgtgccaccactgcctggcgaatattatgaatttatattataatgaattagaaaaatctatttgttataaaattactcatcttgaaatctgtttttgttttttatatattattagttttattagttctgagtgtgtagtttagtggcagaggacttgcctagagtttgcaaggctctgggtttgatccacagcaatgccactcttccattctgaatcccaccttaaatcctatcttaaagttgaatgcagctctgcttcccttgttcctcttaatgagtgtatagtgttccatggatggcaaatgtgctcattttttttttttaaatcaactttgatacaatttaagagtcatctcagaagagggaagataaaagaattgcctccaccagattggccttaggcaaatctgtggggaattctcttgtttaaaaactgatgtcggaggacccagtccaatgtgggcagtgccacttctgggcaggtggccctggctgtgcaagaaaggtaggtagttcagcaagccagagacaacaagccagtaatcagcattcctccatggtctctgcaataattccttccctgacttctctcaatgatggacagtgagtgccatggaagggaaagatttaaaaataaaccctttccttcccaaattgcttttagtctgaagttctatcatagaaatagaaagcaaagctgggcaggaagtcaatggctgtatgtactttctctttccaatctcagttccccactcctcaactggtatttcctgtgattatcttctaagaaacaacaacaggttttggtgttccttttcctcaggcagaaatccaataaaaggttagtggtagaacacttttttagggggttagctttctcctgtagcactggttcactatccttccacacacatgctatggttacctcctgacagactgcttcagtctctgctcatggctgatgctcatatatacagagtgtttctgggaaaggctttataaatgggaggaagaaaacacttgagaatatctatggcttttaaggaagtttccctgaatggatataattaataataaaaacaaaattcatgactgaaaatacctaagatgttttcgaagtttctcaatctccatactttgttcagttactgttttcaggaagtgttggttagtctgccataagaacaaatcaaaaacatccagtattagaacatttaggaactgcatttcccaaggtaacataaagcatataagcaaaaaccaaacacaaaacaaaaaataaggtaagattcttgataattactatgtttttttgagggtaaaatgtaaccttgggtctcttccttccttacctttacctccatggatcctgttccaaactacctgaccctgaattcctgtctgagggcttcctctggctgatcttttactcatctacatgtgtaggaaactgaaaaatgttataggttatggaatcagtgttgaatcatgtaaaacagtttaacaatattgatgggattgaggtattagtaatgcaaatttctgtgttcatgggtgggacaaaaactatgtctatcactgggattaagctctagaaagatggctaatttatctagttatttttaaaattgacatgtatttactggacaaaggcacagacatagtacttgaaggtcaaaagccaacttgtgggaatcagttctcatcttcttccacatgggtctcagagaccgactcaggtcttcaatcttagcagcactacatttatccaccaagtcatcttcctggcccaatttattttattttaaagttaattaaaaacaaaacaaaacaaaaaacaccaaccaaccaaccaaccaaccaaccaatcaaacaaacaaaaatgggacagagtcttgttatatggcccagattggtctcaaactttccatccttttgactgcttccagagtgttaggattacaggaatactcatctgtgtgcagcttatttatattttgttttattttcattatatgtgttaattgtataaaataatgggtttcattatgatatctacatgtacaaaaagtgcttcaatcagattatcccaatcggttataatttctttgtccattctcccctttactcttttatagctctacaatcccctttaaaattaaaatatgacatcatttcctctcttcctactcttcccatattctatcctgtatatccctttcaaattcatggtctctcattctttattattatgtgtatatgtctgtgtgtgtaaatgcaacttactgagttcatttactcttgattatatgtttattcttttagggatggccacttgtgattgaaataatcatttagggtgctcatctctggggaagacaaattcttctttaagttgctttcagtcacctgtaggtattcatctaggggatatctgttaagtctatttggccccttgtataatttcactctgtagttcgtattaacttttttatctggattatctactactaatattgagtggggtactgatatttcccactattattacatccctttacatcgagtgaagcttgtttatgaaactgggtacaccaacatttcctgcatatatatataaatagcagttgcatttctttatggattgttcctttgtcaacatatagaaacctttatcttcggaataattttgacttgaagtatgcactgcatatatgggtttttgctgttgataatcctagaggattttttttttctgagttgaacatgcagggtttggtgctaattcttatttgttcatcattcctcatgaaaatttattcttaggtctcatgattcttttctccacatttctgctttggaatctttgaaatatattccttagtgctggcttagttgtcatgtgttgctttcagttgtgttcatcttggaaggtctttatttctccattgattttaaataactttttggatatgataatcttagttggcagttatttattctaaaagattgaaataaatcatcccatgttttcttggcttagagctcctcctgaaaagagaggtctgatgtaattctaatgagtttgtctttaggagcaacttgggatttcactcttatagttttcactattttgtttttgttctgtactcttggcatttaactataatgtgacaaggagacattctttctggtcctatttggagttcttaatggttcctattcttggattgccatatctttttgtagatttgggaaattgtctgctatagtgaacaagttttatacatctctttgcttttctaaacccagatccttcttttgctcttaaaaatcttcagttttgctagttactgaaaactgtggtaattattttttaaaaaattatttctaactgctaccaggaaagaggtctaaaacttatcttcaattccagattctatatttttatttgatttattaagactttaattcctccctttgaattatcttattctttcatttgatttagtctcctccattgaatttgtcagggtagtgtacagtgttctttagttccataatttatatcaagaatttaaaaaatctttgtttaaagttcacatttcattaatgtttttcattttccccagttctaaaccccatctcctttatttagggctgatttctgaattttatgggttcctatgaaacaacaactttgttttttcacttttgggggtgactgtagtggtttctagacatggaagaaaactgaaatcctcctgggctccaaagactgacaacttacaaaagaggacctccatcaattagctagtcataggtttgggaggtgtcctggattattttccaccccctagagagagtggcagcttttgtgtacttgctcggtgataagggcaatactgtggcatacatcagtctatgtcataactcctttatgtatctacactgtgctggacagagcaccaagactaacaagactgacacatttctggaaagccctaagaagatagggtgctggatgcaaagatctgttctttcccacaggaggaagtcagagctgagctttcattcattagctggtaatgagtaaggtgatggacagctactagtcccaacagcaccacactgccattctctgaacagtggctaaactgtctaggaattgttaagaactccaggacaaacaagatggaagttaatcttttgagacagagggtctagctgtgtacaccaatcttttatttcctctggaggaatctgggagctagggagtctgatttttgattatatcgtcctatggtgctagattgggaaccactcctataataaaaaacaaaacaaaacaaaacaaaacaaaacaaaaaaacccaacccactagttttactgtgcctggtttcatcctctcctgggatgcaggaacttttcagtaggttctggattgctgaatcaatgtgtttgtggagaaagtagtcagggatttctacgctgacacattccttcagtttcactacaataaactttatttaccctacactgcttacattattgtgcatctacaagagcctagtaaacgaccttttttaaatgggaactgcttgccttttatagggactgctcctttttgttttgatcttgactcagatttgctcctacaactaagctcttaatgttctttgatttgtatacaattgtttcatgacagctttgttgcttactggttaattgacacccactatatacattaagaaaactgtagttcttgtctgacactatgaatttttacttttataaagacagggtcacatctcagtatgtagactagcatggtcctaaacggaaagatagctgtctacctttgcctctgactcatgaatgctggacttaaaagtaccacaccatggtttcatataccccatgaatactcaaacatccttttcctatgactttcattaaaaatgtttaggcgttattgaaacagtaatgtatctacagtaggaataccaaaggattatataattcctacagttctgggagatacattgagacaaatgataaataattgctacattaggttaaagtactagtttccatgtagaaatatattattataagcctgtcttttagtacatttcacttgaattttaagactcctcagaaatatattgtaaaaaaccatacaaacaaataacctatgattagaaatcccaaatattagccaggtatggtggctcatgactacaatcccaatactaggtaaagtgaggcaagaggactgtcaggagactgaagccagcttgggtaaatgaaagcttgcctaggctacagtatgagcctatgtctcaaaaataacacaaacatacaaggagatcctaaatgttagtataagtagaagacatgtgattaaaggataataaaatagtgcaataaaatgggatgacttacttttgatgacataactactcttaagcatagatattgtttagttattagcaagaattagcagagtaactagggaagaatgaaaagcaaagggagggatcacccagagtgctataattctattactcaacaatgagtaaaaacaaaattccaaggaggtaaggaaagcaaaaggaaaatatgagaattaaaggagattaagtagaacaaaggggctggattatatttgttaggaaaatgtaggggaatttatatatattatggttaatgttgacagttaatttacagatagttcttagtttattctttttaaagaagcaattcattcattcaacaaaaagcacatttctagctgtgtgtaataagaaacaataaagattaaatgtgtgcattacttttgagggcctgatggtctagatccctgtattctttagtaatcttgccaaatatcctgagagttttccgattaggatgtacttcaaatacaggttggttgtatcttcaaagggcactgtaaagtatgatcagttactgaatatgtaagaagatcagaaaaggtactgcctatatgttttaataaatacaacatgatttctactgtgatgtaaataagcataaataaatatagttacagtttctaatttgtaaaaattaggtacaggaaatggttatttccacttaccatttctatgttctcattagcaacatgaagtttcttggttagttgttgaaaattattcagctgatcctaataggaaagtaaggtgagtccatagtattttgtttgtagcccatactttaaataaaactaaaatcaaattatatgcttatatttgtatgacatcagcattatatctgctattatgtggattagtagtcaaataaataagaataaacttttaatgatcaaaaatttagccaggtagtgatggtgcatacctttaatcccagcacctgggaggcaaaggcaaacagatctctgtgagttcgatgccagcctggtctacaaagctacacagagaaaccctgtctcgaaaaacagaaacaaacaaacaaaataaacaaaagaattaaaaaggaagcaatgtgatactaatgatttgtattttatataaaaaatcatttgtataaatttgtccactggtaaatactatcttacatataaaagaccttcatttacaaacatttgttaagtgactagaagtttcaaaagctagagagtacatgcatgacactggaaaccacacattcaaacctatccaaaatgagtaatataaactgtgcaaaggagccactgtggctcttctgcaactgttgtaaagtccctgtattctacaagtttaaaatcatttgatcaggttatacggtccttttaaaccaagtaatgtacaaataacaaatttacaacatgttaacatgttagataacatgttgttaacatgttagataacaaaagtaatggttaatagccaaccaaggaaatagagataaagtattatttctaaagttgtttacaaaaaaatcaaattatataactacagtagaagaatgatcttaagtgaaaacaacacaataatttgagggcttagtttttgccttgaaaatttacttttatcaaaggtgttttatattagatattagaagtacaaattctatagatcagattatatgtgttattagaaatcacagcatggataatacaacaaaaagacatcttgtaaactagagtatcatataagtaccattagaattacacaggcagaaattcactctgatgataagaatattcacaatcttgaatttgaacaattaaaaaatcagagttaagataacccacttatttaaacacatagttctgaagatctacagaaaatgctcaaactgtaatcttcccatagtatttaaatgtatttagcagtaaaagaaccaacagaaaaacaatgaaggcagatttctcaatgggaaaggtggtctttatgaaatagttttattaatagaggtataaagcaaaaggtagatgcccaatgtaaaaacactcttgctttagacagaaagacatcttcaataactaataagacttcttcctatgagggtaggggagagagagctgccacaataagagcaagagaagaggagtagaggagaggaaatggaggagcagaaatattcatttgggggaagaatagaggagagaaagtaggatgagagataccatatcagagggagccactataggtccgagaagagatctggaactagggagatctccagagacctacaaggatgacacgatctgacaatccaggcaatggtggagaggataacctaaaagcccttcccctaaaatgagattgatgacttctctttatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatctggaatttagttgaagagagggaggaatgaaggggtgtgtaccaggttggagaaacccacaggaacaactggcctgaacaagggagagcacatcgaccccagatgctgtcagggaggccagtacaagactgatccagacccctgaacatggatgtcaataaggaggcctctgcactccagggagcctctggtggtggtttagtatttttccctggtgcaagaagggactttgagagccagcctggtttacagagcaagttcatagagaaatcctgtttcgggaaaaaaaaaaaaaaaaaaaagcaaacaaacaaaaagcacaacgtgcactgaagcagttctttgattattcatatttttaaaagattctgagatacatttgttaattagttaaaaaacaagtcttagaaacttctcaaaatagttattttttcatgatttttatgatttctcactgatatttaagaaaatcatgaaacctaggttcaccttttgcttttgattttcaaatacatgaatctgggcttcagtcatatgttcctggtagagtttccgtatactttccaactcctgagaagcagtctgccagagttccagagcccaagctttctcctatcaaacaaacaaacaaacaaacaaacaaaactgatagtttattaaaaagtatcagcaggctatttcattatagtattaatggatcatattcttttacaaatgggttcttgtaaaattagaaagtaaaactagaatgtatataaagatggtagtcatgcattgtttaatgatgggaacacttaaatgtactattaggaagtttaaccattatgtgaccatagcacatatacttaacacaagatacaatttctacaatcattactaggtgatgcaatcataggtagtaatactgtagtccatcactgacagaaatgtgttatgtggcacatgattgtactataataatactcacgatttaaaattttaatagtactttagagaacaaatttaaaaactaaaatttccttattttgaaattttacttagatttaataactaaaattaatgttatcagcaatactaaaaattaatccccagggccagatggcttcaatgcagaattctaccaagaattcaaacaagagcaagaatctacaagaattcaaacaattcctcaaattgttctagacaatagaagctgaaaggacattgccaagctctttttacaaggctacaattaccttgatacccaagccacaaaaagacacaactaagaagagaactacagaacaatatcactcatgaacattgatgcaaaaatactcaaaaaaatattggcaaatcgaatccaagaacacatcagagaaatcatccaccatgattaactaggcttcatcccagggatgcaaggatggttcaacatacaaaaatccctcaatgtaatccaccatataaacaaaatgaaaaagaaaaaacacatgatcatctcactagatgctgaaaaagcctttgacaaaatccaacatcccttcataataaaggtcttggagagatcagagataacagaaacatatctaaaaatgataaaagcaatatagcaaaccaactgccaacatcaaactaaatggagagaaattcaaagcgattcctctaaaatcaggaacaagacaaggctgctcactctctctgtatctcttcaatattgtatttgaagttctagctagagcaatgagacaagaaaaggagatcaaggggatacaattggaaaggaagaagtcaaactttcactatttgcagatgatatgatagtctacataaatgaaccggaaaactctaccagggaactcctacagctgatgaacactttcagcaaagtggcaggatacaaaaccaactcaaaaagatcagtagccctactatataaagatgataaatgcaatgagaaagaaatcagagaaacatcaccctttacaatagccacaaacaacataaaatatcttggggtaatgctaaccaaacaagtgaaagacctgtacagtaagaactttgagtctttaaaaaaagaaattaaagaagataccagaaaatggaaagatctcccatgcccttgggtaagtaggatcaacatagtataaatggcaatcttgcgaaaagcaatctacagattcaactcaatccccatcaaaatcccaaaacagttcttcacagaccttgaaagaacaatactcaactttatatggaaaaacaaccctgtacaataaaggaaattctgtaggaatcaccatccctgacttcaagctctattatagagccacagtcctgaaaacagcttggtattggcacaaaaatagatagacaaatggaatcaaattgaaaaccctgatattaacccatacacctacgaacatctgatttttgacgaagaagttatatttatacaatggaaaaaataaagcatcttcaacaaatggtgctggagtaactggattcagacaggtagaagattgcagatagatccatatctatcttcatgcacaaaacttaagtccaaatagaccaaagacctcaacataaatccatccacactgaacctcttagaagacaaagtgggaggtacccttgaatgaattggtgcagaagaccaattcctgaacataacaccagtagcacagacattgagatccacaattaataaatgggacctcctgaaactgagaagcgtctgtaaggcaaaggacatagccagtaagacaaaatgacagcccacagaatgggaaaagatcttcaccaaccccacatctgacagaaggctgacatccaaaatatacagtgaactcaagaagctagtcaccaaaacaacaaacaatgaaattaaaaagtggggtgcagaactaaatagaaaattctcaacagaggaatctaaaatggctttaagacacttaagaaagtgctcaaaatcccaagccatcagggaaatgcaaatcaaaacaactctttacaccggccagaatggttaaaatcaaaaccaccaataacaaactatgctggagaggatgtggagaaaaaggaacactcctccattgctggtgggagtgccaacttgtaggaccactttggaaattagtaaggtggttcctcaggaaaatgggaatcagtctacctcaagatccagcaattcctctcttgggcatatacccaaagaattcatattcacacaacaaagacatatgttcaaccatattcatagcagtgttgtttataatagccagaacctggaagcaacctagatgccccttaactaaataatgggtagagaatttgtggtacatttacataatgtagtactactcagtggaaaaaagcaatggaatcttgaaatctgcaggcaaatggatggaactagaagaaaccattctgagtgaggtaacccagtcacaaaaagacaaacatggtatgtactcacttatatatgaatttcagacatacagtaaaggattaccagattacaatccacatcaccaaaggaactaggaaacaaggaggaccccaagagaagaacgcatggtccctcagaaaaggagaaggggcaggatatcctgagcaaattgggaacttgggggtaggggagagggatctgggagaaggaaaggggaagaagacgaggagagagaggaaatcagggagcaggaaggttgagtgggggaagaaagaggagaggaggatgagagataccataataaagggagcgattataggtttaaggcgagatctgacactagggagatttccagagatctacaaggagaaaccaactaagcaatagtggagaggctaccctaaatgcccttcctctataatgatagactgatgactgccttatatgccatcatagagccttcatccagtggctgttggaagctgaggcagacacccgtagctaaacactgaactgaactcgaacccagttgcagagaggaaggagtgatgagtaatgaggtcaagactgggctggtgaaacccccagaaactgacctgaacatggatcccagactgatgtctgggaggccagcatgggactgatccagacctctgaatgtggatgtcattggggaggcctagacactctatggggcctctggtagtggaccagtatttatccctgaagtaagaaaggactttgggagcccatttcacatggagggatgctctctcagcctggacgcatgggggagggcctgggccctgaccaggatgacatgacagactgtggagatcccccatagagggccttaccctccctggagagtagaggggggatggataaggggttggtgagggtgggggaggagaggagggaaaggaagcagggattgacatgtgaagcaggcttgtttctaatttgaactaataaaaaaataatatcttggaaataaaaccactctacttgtctacaaaaaagtgcaaattaagccttgacattactaaatgagaaaattccttctgagaaaatacagtgtgactttctgattataaagagtttattgtacttattctagtgcttattgtagaaaactaggaaaatatggaaaatagaagcaataaagaactactcagaagtttaggtattagctgataaatactactaatttggatataatagtctttataaatgttgactctgttcatgtctatacatttttataatgtgcttctgggacacaactttttaagtaaagtcctacttagaagtttaggtattagctgataaatactactaatttggatataataatctttataaatgttgactctgttcatgtctatacagttttttttataaatgtgcttctgggacacaactttttaagtgtttttttagcaaaattataatcatataatgtattatgtgttacacataatgtaactctattttacttggcattttatagtgaggtttttttaattaatcaattaatgttttaatacagtcttaccagctcagagtttaagatattcagaagattttgaagtcaaaattatgtttataacaacaggaaaacaacagtggaattttctaaagcatatgctaggtcattcctgtgctgagggctggcagaaagtatgcctatctcactattcaaaaaataaagcctgttaatttacagtagactaaatattgacagatataactcacaaaaaagtacttttggatacttaaataaggtaggtggtccatgaaggttcttgaaaccaaaaggctaagaaatgctaacttaaccctctgagatcatacaaacagtaaattacctatggtccttaacaagttttgactaagattagaaaacaaaacaaaacgttttctcgttgttgttactggaatgagaaatgtccctatgggcatctgtctttggactctgggtcctcatttggtgatactgtttagggaggttatagaaactttaggagatgggccttgttagaggaagtcatcactgggggcaggttttttaaggtctgtatctttgtcccacttctagcttgctgtctctgattcctgtgtgtagctgagatgagatctctcagcttattgttcctgctgctggcctccatgacttccccaccattatgaagtctaaattctctggaaccataagccaaataaatcctttcttctttaagttgtttttggccattgcatatgatcataatgagagaaaatcaactatatattctttatctctaaagtttaagctttggaattccaggtaaagactagggaattatctgtcttattcctgcaaagctagcgctaaaagacaggcaattttggtctatcctgagtaagctttcaggatacaggattttaagtttctatcaagtgattactaagtataacatgcactcagaaaacgtacaaatgaccactcccaccccttgacagtgtcatcaacagctccaatgatttttcttcatccacagagctacaaagtagaagagagattcaaactcatataaggtctgagatacagagatgtaaaattataaagtgaaataaagctcctttatgtacaaattcataaaaaatttaacactgaaaagtgaaatgcacaggacacagaataccagaaatttcaaaaaccatgaagaaagaaaaaagccagacaacgtataataattatgtttcaatctttgaaaattgaaaatggtatcagaaaaaaacacacaaaacatgtaaatttaaggaaactaaatctttgattacttctttctttagagttttcttctaacattaattattcttaaaggacaaaaaatgttcaaatgtcatatgattcaattaaaatatatttgaagctatatttgtaatagtaagagcatttattacaagttttaagcaaatacaatcaagtgctataaattttgttattctgttcagtaccaaaatataagccctgaaatcaaaaatacaaatgacattatacagactgaataggttatattcagagagtacatatatatacatatatgtatgtaataacaattaatgaaaaaaggtcatgaatttgagaatagagcaaggaagaatatttttgagggtttggagtaggaaagggaagagaagggagaaatgatataataatatcaaaaataaaaatgtaaagattaacacatatttctgaggactttaaacttactaaataaaaatagtacatcacttacctgattggctagttgcaactgttcctgaaggttcctcacagtctcatcatctgcacagatgtcatttcctatccctgtgccaaagggaagggcttccaattgcttttcaacagcatcttttaatttactgtgcaacctttgcgataagcagttaacattatacttcttttaataagagtacaattaccactggggggtcattaaatcaacatgggtcacacataatactttatacaaaaatcgcttaaatgaaaataagaatggaagtactgggaggtgctatgtaagctaccaatggggtaaaatcggtagttttatccggccgtggtacctatacacacaacaatgaccagcatatcatatccctagaggtgaaatagtagcacttctatcttctgagtaaccaaaatatgtctaattagaattaaggcctgctctagaagaggaaaaattcagatgtagtactatatacctagccaactatctaagactgatgtgatgagtccaggaaacctagaaggaacccactactgccactttcctaaaccaatataatctctaaatgtattcattccaaatagttatccttatacccccagataaaggtaatctcagctctcaactgtatactactgttgaaagctacaactggccaaaacaaagaaaactgactgtgaggtgcccagacacattctatactactaccccaatatctgagactcagagaacaaaggacgaggaagcagaaagattgtaagagccaaaggaccaggacatctgctaagaaactgtgtcttctacataggtcagggaaagctacacccatggtaacctaaacaaagatctgaacaatgacactggttgacatgactatgaaaaggggaaaccttacaaggctttatccttagaggaagaactataaacaattaaggactattgagagaggcaaaatttgtggttacctaatatcatgtggtcagccctaaaagtacataggagagtggcactaaatggactcagtaggtttgttaacacacacacacacacacacacacacacacacacacacactgtatgtatgtatgtatgtatgtatatatgtatatatatatatacataaacctgtaataataataataataggtaaagaaaaagaaaaagattttgtattgcaattaataggcaagaaagttccacaagaaagaagttaaataacttgtttaaagtcacagttaatgaagccaatagtgaacagaaattcaagcccaggagtcttcatgctaaaccactgtactctattatcaaagaacaaaaatataagttacctagagcaacaaaagaccaattggctaattgatttacctttcgttttcagtgatgacagtttcaagttgtagtttcatctcacccatgtgtttctataggaataaaacacagtgaagtaatacattctccagtcaattagatctccatttagtactgaatttacatgtaagcagtcaggatttttggtatttacagataaaatgtattcattatatttaacaagcagtatcacatgtacatagtttaacaatgtaccaaacataataaaacattcattctggggctggagagagggctcggtggttaagaggactgactgttcttccagaggtcctaagttcaattcccggcaaccacatgttgactcacaaccaccttgaataagatctggtgccctctgctggtgtacaggcagaagactgtatacataataaaaaaatctttaaaaaatgtttcttaaattcattttgaatagattataaataaataaaaatattttatgtaataattgagaaacattaaaaaatatacatccaggaaaccaaaagatatacttcagtataataaaaataccagttgagttgggcatgatggtgtatgcctttaatcccagtgctggagagatagatcgaggtaaatatctgtgagttgcctttaattccagcacttaggagacagaggcagggaaatatctgtgagtttgaggatagcctggtctacaaagtgagttccaggatagccaggactgttatacagagaaactctgtctcagaaaataaaaacaaaacaaaacaaccagttgactgttataccttgaaaacatatcttaattcatcaatttaggggaagcccatatcagtatgtagactctctcctacttcaagaggcaaaatgagaatggtgaaaaagaaaattaaggtcctctttagcaattactcactatctcaccacccttactaattatatgaactctgctctaaacaaggttgctatggtaaacagacatggccactgacatatttagcaggctagatgacttaaaaacctgctaaccaaaatacaatcaagatcataatccatactgtaaagagaataagataaaagtttcactgattttctctgaggaaatgaagagattattaacatttcaaagggaaaggaagagggaatttaataaaagcaaaatggcaaaataatgagtcagttttcagtaagagctggtcatggaaataacgtgtttaaaaaaagggtacactcagctcaaaatccatccatcagtcctgatggtgcactctaggggaaaggagaagagccaagcctggagcagacctggcaagagatgtgtgaacaggcagctctccaagtctgtctctctcctattcagagaggcttacagcagcttggcttaagaaatcactaaccaccttttaatacaaaattggcatcaaagttgaatttttctcaagttctggctaggccagaatttcagtcaaaccgaaatgacttaatgtactaccagataactgagtactgatcatatttgcaaaaacactaacttgaaaagtatctaatactgtaaatgattacatagaatatgtgtattacataagttgcaataggactttactataaaatatttgaaaatatttatttggaaggaaagaaaatctatagagtatcttttatatcatcaaaatttccctactatactttttcggaggtgagggtaggaatctttatacataaaattacagcatgcttttcccgctttgaaggtatactatttcttggtcacatctgtaattcttttttctttcaatgtgttagattttgtttgtctgtgtttttgagagtctctccatgtagtcctgccggtccaaaactgtctatgtagctaaggctggcctagaactcatagaaatccacctgccttgcctcctgaatgctgagaccaaaggcactcaccactatgtccaagtacatctgtaattcttaaaattagttctacttattaattatatctatgtgagcatagatatagtattgttagaagtagctatctgtagggcacacaagccagtcaaagatggcactgagcggaagtcagatgggcgagtcctaagatgtttacaaaaaagatgattggctgcctagatcaaaccagatgaggttactacatgaacagctcatgtgcactaggtaaagcatagggcacctagggcagtgataggctgacctttaataccattggctggctgtttcctccactcctgttttttgctttaaaagatacttgtgggacaataaacaagttcctgcttgattagactctctgctgtgtctgattgtctctgggatcctgggagactagggaactgatgagcagtgcacttacccacttacccttctaacatcctgcagacatcaacatatttttcctctctaaacaatgtaacactataactatcattgaagacttctgggcttactagtgtagcttctacctataactaagtcagcaatcacccatagggggttatgaacaccaaatgagaaatttaagccaaacacttcagaaaaacagctcattaaagagacacaggatcacataggttataacaggttttaagagagtttaatttccagacaactagctattcagaaacaagtgaaatacacactatatcatcacagcaattcaaagagtgaattcgagatgagatctctcagcttattgttcctgctgctggcctccatgacttccccaccattatgaagtctaaattctaacttttgttctttaattgcctatctaaagaaaaaaagacattgttatggttggtttaagtctgaatggtcaaaagcgtgtgtgtgtgtgtgtgtgtgtgtgtgtgtgtgtgtgtgtgtgtgtgtgtatcataaagaatgggaaataaattaacttaagaaagtgtcttatgataatacagaatctggttccatttggctctacaacttcactttataagtttataaaggaataaacttggaaatgaaaagtctacataaactttatgcaaaaaaactaactttattcttaggagtcataagcattgtgctctcttagtaaaggtatatatcaatctaataattaaaaaattaatactgttaaaatcattaatttagatataactctcttgtttccatagccctgggacttacctgacattcaaaggcctatactaaagttgagtataaaatgtcccccatagactttcactttgaaagcttatgttcagaggtgggaccttaagaagggtgcatcataagagctctaacttcatcaacaaattaatccaaagcttaatggacaattcagagacacagcctattctgaacacacaggtcaccaggggtatgccttccaagggtttattttgaaatagcagcccttttcttctctctgcttcccagacaccatgaagtgagcagcctccttcaccatgttctccagctaccatgatattctgtctcttctgaggactgagccaggtatcccagattgaaatcattttcaaaaatccaccttccctcctttaagttgatttttctcaggtattttgtaagaaagatggaaagtcatcaaagcttactatgggctacactttttaaaacacagcacagaatttcttcctgtctatgcattaagagaatagacaatggggctagtaggtctgtcccatagtagcactctgagaaaaatcagtctccagggcttatttttatacaaagttattacgcgttctcacatttgaaccaaattaaccctgctttctttaccattagtgattcagggtctagtacctaagccaaatacaatcactggtatattcaggctctaacaaagagcagccattgtcagctagggggcttagcctgagacacagaagttctgattaagaaataattctaaatattatctgctatttgtatttctgttgtttgtgaattgccattatttgattggcagctttgtttttagtgtttaatttttacaattctttatacattctagaaggaggcagcagcagcagcagcaactttacaagaagacaacaacaaatgtagaaaaggaaacactagggctaagaggtatagctgagaaatggggttaaggaaaagtgcaaatatacattgaaggggaattaagaactaggaaaaccccatatggaaacctattgctttgtaagctaattttaaaaataagaagtcttttaaagatgaattatttatattgctatgctggtatcaaaaattttaggagaaaaagtaaaagacatttatttcaattaaagtaatgaaatgtgagtaactgaaataacaatcctgtattatatttagtttttcatgagcctaatctcagaggcccgagacagatgtgcctatagatagcctcctgagtctatttccattattcttaaaataaacttgcactagtaatccaaaaaaaaaaaatctactagaacctaagcctatactggaagtaggttagtaatatcttatctaaaggcataagataatggtatctgacagatctgaaaatctcggaaaaccattctacaaatagtgacaaatgtaggtaaaataagagtaagttataaaaggctatgaaatggttctgagcacagagatacaaacaaataataaagcaactaggacacagctccaagcttctgaaatatgcctctgccagacagcaagaacaatggaataccagagttaaaagaaaactgaagataatgtctaaacatacacatttacagatgaatgagactttcatatgttcttctcagagtaaagctgtacaaaagcttagtgattatgacttttacctggtaataggtcaattgtctgcttagctcttccagatgtttctcatactcaacaataagaggaggtaaagaactaaaggaaaacacagaattaaaagacagtgtatttagttccatttactttaattatctaacaagtacataaatccaaaaataaaaatttgtgtttagtaggaatcaatattttgctttttttcttaaacccttagctcaaataatattttggactgaaaccttcttgattatgtgaaggggaaggaggagagagggcttgagcactgaaggatgacaaacagcttctctggcttccacccagtaaagcctcactttccacagggtttacttgtaaacaaatcaaagacgctcccagatattaccaaatatcctggagtcagacaagatcatcctccattataatccacttttatagactccaccaatatttttatgaactcaatagcataaacattcctaaactgaagcactctttcaatgaccaagttatttaaaaaatagtatgtaactggtaataccttacctttgttcatctgtggagtttactagtacatcacctctgcctcctttagacatgctgttctgtaacagaaaatagtcttttaaaaatgttttctcacagtattctagataaaattgaaacagccttaaaattaaaagtcattaaaatttttataactttacaaaatttatcataagaaggaaaaaaaaatactgatttgcccttggtaaatttaaccatacaggataaaagttggccaataataaccatgaggaatattctatttgatgaactatctaccaaccatcagcactaattatcattatttgtggtgaataagagaagcttgcattaagttcagtaacaatacaagtctgtttactgttcaaagttctggtcaacacagtatataagaagatttaaaagctgaacaacatgttactattattataacatacagataatttgatcatttacctagaaaacaccacataatacaataaatgttagggcaaattagagagtacactaagtcctagaaagaagaaaacactcaacagaaaattcagtagttttctcaaacactaacagtcattttcctttgatctctgaaaacgatttgcgaactttatctttttaagcagccattctgtttcactagtcaagttctaattcctttcttcttttgctgaatttaatttgctcctgtttctacattttctaaactataaataaatgcaattccaatgtatgagtttaaaaatatgtattaatctttacttttttctttctaactgtggatttacatggaattgtaggaaataatgacaggcagttttgggcaactttcctcaatggaaacattttgttaagtcacaatacaacatatagatattccctaacttaagatggatgacaatctcttctgaggttgaaaatgcatttaattcactcccctagaaaacacgggggctcagagcctgtagagtatgtttacacttgtgattatacagctggctgagagctgggctcacagctgctgcccaccttaatcagactatatattattaattcaagaaaatatatgaatgtgcatcactttcacatcatcaaaagctgacaagtggtttgtcaggccactgtagactggagatcttctgtagtataatgacctaaccaagatagagataccacatacatgaacatgatgataaagttttaatcatgggtcacctggcaccttttggtgctgggcagatggggaactgttatggtaagcaaatggatggtttactatgcagagagagggagagggagagggagggagggagggacagagagagaaggggggttcacttcctgtagacaaaggtaggtggcttgattgccactctagcatggtgatgtctggacctgggcaggagcccatgcctaaactcatgaccctgatacaggcacggtctgtattgatgtctgaggtccttgataccaccaaaggccaagaggacagggctgtacagagttggcccagcccttcactggctgcaacaccagaactcttcttgccccttaccagctgaagcactcaggagagagggcccaatgcctcccctggccagcacagtagagctgaccctatttgcagaggtagaggccagctggccctggggggtgtgaaactgggagagcaggtcgcacccctctcatcggccatctggtagtatgggtgagggaaagatgctcacctctcctcttcccctactgcctccagctagtgagggagctgacccctttaccagctgcaagccctgaaccttgtctgggcagcatagtggagctgaccttgttgaggagggaacagatgagctaccataagaacatgagtatgggagacctggccctgtccttcatctgtcatatgacagcaggggagagagattaatttccccctgctcaagtgggaaagctggccctcaggtgataagagcaggagagctactcctgctcctcatcagctgcagcactcaggagagtgccccctacatcctgcctgacaacccagtagagctgaccttgaaagtgtaggtgtgagagaacctatcctgaggatgtgaaagtggtagaacctatcccaccctgtgctcatggctgcaaggggtaaactagccagggaaatgtggagagttcaccttggtggtgaggataagtgagagctggcaggctgaccaaccctgcaaccactcaggcctagaaccagggtcaagtgttggcccatccccatcatccaccccatctgtaatctgctgaagcatggggaagggggtgttagtcctctggacctagggctgcaggatctctatgacagaaacaggatgtgcagaaagagtcccagtgaaggcccagcatcaatggtgcagcaaagaccaggggctccaaccagaccaatgattctttgtgatgaacacctgcatgtaaagatgtatggataggtggatctctatgagttcgaggccagcctggtctccagaacgagtgccaggataggctccaaagctacacagagaaaccctgtctcgaaaaaccaaaaaaaaaaaaaaaaaaaaaaaaaaaaaagagatgtatggataaaggggcttactatgtgactcactgtgtcacactaaagcatccatgatgacattttccctttcttcctttttcttttcccccatttttatcttaaattttgttttattttggtggggggaggttgcagaggcagagatgggtgggatcaggatgaatgatgtaaaagacacaaagaataaataaaaaattcttaaaacgttatataaaaaacacccaaagcattgtgaaacataagaaaccccccccacacacacgaaagttttcattagccaaggatccctcagtgccccttttagccacactacctttccattacccttcctttcccccaaacccaggcaaccatacatgtatatatttttccccatttaaaaaagactgttaatgtgaatataatctcctgggattggctttttcccccttagtacaatatccaggatatttgagaacacatttcactctgtagcttaggtgggcctcaagctccttgatcctctgggtgctgaattataggtttaagccatcatactgagctaactcatcaccttctattgtccaacaatagtatatcacaaatacaaactacacacttagagacttttaagtgtttctaatttaaccactttcctacagatggtatctgtattataagtaaagctgctaaatacacttatatacaggtttgtgtatacatgtatgtgagtgtgcagatgcacatgtgtgtgaacataagttgtcattcatttgcaatagatactcaagagcacaaatgctgagtcaaatggctgttgcatgttttctgtttaaataagttaccgaataattttccggaatgtctatagcatttacatacccaccaacaatgaatggttgccaacagtccatttccatcactacaacagaatttcagaggttgtatgtctgaagagagaaggtccaactagctcatacttcttaaggttcaagaggatgatgccagcttctgctgtgctctggcgagcacaacatggctgatggcatcatgctggaagcacatgcaaaggttaagaatcatattgagacaggaagcctaagagtgcttcggagatcaggcttcctcttttgtaacaactctcatgagacaaactaactcactcctagagagtttagcacgaatcccttctgagatacatgcccctaaagacctagctagccacttgccatgtggttctacctcttctgaactttgtcacagcaatgaccaaaactctgatatatgaacctttggggaaagaaaccatgaaatagcatttgacattgccactgttttatttgtaaccatcatgtgaaatacttcatcgtgcttttaaattttagtgattgtgtgaagctgaataatgaacatatatgatatttacatccaaatcacaatacagtattcttaatggcagatagcatgcatatctagacctccagaatttacagtcttattattattagcagtttgtaatctgagcaatactttggtcttcccacattcttgccactaggactatactcttatcttttatataatgcagctaattgtgacagactaaactgcaagtaaggatggcttttcctgagaattttctccctagaagaccagcttacatgaccccatagacaaggacctaaaaatgggtaaccaagaatgaccgcagctatctgttggtggttgtgacagcattaactttctgccatggtaaagctataaactgaccatgtaaagctgagaaaaaaagggaacaaagtttagctaacagccagcaagacacttacatggtctatgatggctatgttggccagggccaaacataacaagcagtaaaggtcatcagctagcaaatctcaagtcagagatggggccaggggtgttccacttcccttagtgggtggacagcacacgaacaacatatgatcatctcatgtgttggactagtggcacatgtagaatggcgtctcccctggcttggtctatgagagagcagataattaaataatctcatagcagttatcttaatgtctgtccggtttctgccatagctgtattaaaaagccaagacaagaaaagtcaatggcttccttttctctttccatccctccctccttgcacctgcatgggtattttttcccccttcttttacttttaacctgtgagtgtccttttaagccatggcgactctcttatgaatagcattcacttgtgttgtgtcttatgactggaggattacttcaattacagtcaatactaccaatgcaatcttgctattttctgtttgaagttcctttgttctcatcttcttttgctttctttcactgtgattctataaatagtatgttttgattcttttctctatcatttgtgtatcacctaaatgctttggctttgtatggagcatgaggcatacataaaacatatcaatatgtaatagaggaagctgtttataactgaactttcagaatgatgtacaaaaagctttatattgttactctctcccatacaattaaagtttccaagttataaactatttttttatgtgtgttcttcaggaagtgattgtagttaaagttacttttagcacttctgccttttaagttctatgcaaaaattaaaagtgacctaaatgtcatagtggcaataacagaatattcttgtatgaaagttttactttcataattcaacgtggtaacaatcagtgctactttatttcagcttaatgaactgtctttatcatttgctgcagtttgagggttacaaagtctctcagctatttatcgcttttatttctaatggacagttttgacaggtgaattcttggttgatggctttgttctttacttgaaataaaccatcccattctgtctggttgtaaagtttctgctaaaaaattcatcaacaatcttttgaaatttaatatgtatatggtgagtcattgtctaatgttgctgtttttaaaattctctgaatacaaaatttctgaacactcaattacaacatgtcttagataaaccattttggagttaaacctattttggaaacatgattctggatgtctagatttctcccaagtgttttataagttttcattatttctttaagtaacttttgcaactcactacagtctcactccacccacaggaggaatcataggctgccttgagagggggcatatgtgggaagatgaaacagtttttacaatcatagatgcctttaaattccaatttcatttcatttagttttactttgtcttacagtatgctgtaacttctctattggattcttgggctcttaaaagggaacttaatactgtccgtggatggttataaaaatctatgtactatagagagatggtggtataaatttcctattctatcattcactcattacctactagacagacttctttgaactccagagtgtccaaagtttgtgtactaaagagtgacaaatgtccaaatggaggatgggtgaccttggagagccagcgaagtacaagaccactaagtttcacattgaagagggagattagaaggaacacagtactctctgactctcacatcctgcccagcagtaaaacgcagtgtgaggagagcaagctgaggcagtggagaaaacnnnnnnnnnngccagaggcagccatgagatagccccagaggccaagtaatctgatatccatgaattttgtaatccactggcaacaggactggttctttgccatggagcctgggggctatcctccactatgtcctcacagctctgtgctccttaaatttcttacttcatctatgtctgcctgctccccatgcctcagcccctgctactttgcttgcccattttctaccaggccctatgtccaaaaacttcatgacttatgactgctccttattttttcatctctagaaagctccatctcaaacaatagcctcttctcaaggtagagtctgtctatagtgctctttgataataagaacaatgcaactgctctcttctccaatgctaggctaccacacaggaggagccactattacaccaaataccacaatggatttaaagttctcaaaaactgtgggttccccctgtggacagaactgccagtatgtcattaggagttcctggcataccttttgtttgtagcccagcccctctaccctcactaacactccacttctagctccagggctgaatctgcacactatgttctacttttctccatgcttcttagctgttacaaggataatgaatccccaagggagtgaatgacacacggacaaggatatgctagaaaggatatcaacacccattttatgttacatcacccctttactcaccactgaaaagtacacagtgaaaagcaagatgtgataatggaagtctgggagatatggagaactacacagggattaggagccagaaacaatattctgccatgaagattcagaataggaatcaagatttattttatgattataaaaactgtataaaaagaacctacacattctaagaattagagctgctatagtttgtgtaatggtaagggaagatgtgtccctgactgttttgctactttgaggtttccaataattacaaccacaatgcataatatagacacttctgatagttgtcttgtagccattgctgtgtcactggtaaaaacatggtcacgattaagccagctatagcctccagttatgtgcaatagcacatccagagagcttctggagaccaaaaatttgtcttttgctgctgctactgcttaaacaagccttcagacctatgctataagattaaattcaccttgttgataaaatctgaagttaaagaaaaaagaaacacctcaggaaataaataaaatatcaatgcatatattattattattatctgcattagtttatgcttcagtcataatttctgggttttttaataggggagataggaatcaaactcactgacttacacatgcaggacacttaatattcccagctttttcaatatattataatttgtaataattgaaatagttatatagccaggcatatcttgataaatcactttagtatgtttcaaaacttgaatgaattcccatttcagacctcagcttctttaacatatgtaacattagctccaaagatagaaaaaaaaaacaaaaaacaagcaatttctacggacaaagaatttactttcagttagcaaaatcaaatttttccctataagaatcaaagctaatagcaaaatttcaaaggtaaaaggcaatttcaaatgtgaataattctaagtagaatttatattgaagatctgtattgactataatcaataattcataaggatatagatatatttacaaccgaatttcaatctagtttgttattcttaaatcattccacatacctgcatatttgggtcttttaaaatatgttcaatttgaagctgcctaggaatatcattcattttatcacctgaaaccaagaagaaaaccaatttcagtaaatctacttcgtaaaactagaaaaacagcagctaatatctgatgtatccaatgaaagatttctagtttgtaagattgcttctcataagataaatcatcaatttcagcacatagttttagaatataaaattaggtcttttaatattcataagctaaataatgactcccaaatggaataaagaacagctacaaagaactaatcttttcttgaattatcagtctattttggaagaagtgggaaaatagccccattgtttttttttttttttttttcccacttccaccactaaaaaggattgggaagatatacatcatattcttttttcctcatttccattttttctttctactttgaagatagggcttcactcaggctaatctagaactatagtccaggctggcctgattcagtggaatcttcctgtttttgccttttgggtgctaggactacaggcatgagccaccaccatacctagctgtggaccaattctttagaattcttaaagtcagctagaaagattatccattctatactgaggatacagaatccaatttcaagacaaatgtcatgagaccatgagaatgatgatgcggaataatatgccacatctgtattcacatcaggaaagtgaccgggaaagcaagacggctcagcagataaaggcgcctgtcatcaagccagaggacatgagctcaatctctagaaccaacaggctagaagaacagaaccgctccctcatgttgtattctggcttctgtatgcattttgcctgtttgtgtgtgttcgtgcacatgctcgtgtacacacacacacacacacacacacacacacacacacacacacactgcatgtaagcacatgcacaaataaatgaaaattttaaagaggggctacagaaatcacagtactagttgttgctcttgagaatccaacttcaattcccagcactcacacggcaactcacaattgtctgtaacaccagtttcaggaaatccagcactcttttggtctctactggcaatacatgcatgtgatgcattgacattcatgtaggcaagccacccatatatgatttttttaattaaagaagaataaaagtgaggaaattaaaaagaaaaacacagtaagatattacccaagaaatacacaatctttcaagatttacatgtaacagagcaaagctcaacaactttcaaagaaatggaaaataaataaaagcctccatgttataagaataataactagaatcactaaccaaagcagaaaaaaagaggccaatagggacagtatccagacatgaaaactgaaaaacaaaaacaaaacacctctgggtctcaggaagaattacaaaaatatctattttgaattgaacaatagtttaaatgtaatgtagcttaacttaatagtagaaaagttctatagctttgatttagaattaacttgaatagcctttgttgttcaggtttaggagtttttcatattttaaaaataatttgtatagactttgttgagtacttctaatctgcaaatcccaaatgctaactaccacaaaaagctattatatcagcactcaaatgttccagattttagagcattttggaatttggattttcaaattaggtatgttcaatctgtattacaaaaaaacccaaaacaaaacaaaaggcttgaagaaacaaatctgttgcaaaaggttagaaaaagaacagtgaaataaactcaaaatgtcacatgaaggaagtaacagaaatgaacctagtaaataaactcacaaataacaagattaaaaatataatcatttcctattttattttaacaaacatttgatgaaattcaaggtatatttatggtgtataagactggaagtaccttaataaaatgaatgcttaaacacacacacacacacacacacacacacacacacacacacaaaaaaccaaagaactacactataaatatcacaccaaacaggaaaaatattgaaaacctttcccttagggctaacataaatataaattcttatgacatttattcaacactctagtggaagtccaagttaattaatgcaacactgaagcagttaaatagaggtgtgaagattcaaagaaagaggaaactcagttacatgtgtgttaactagtccagaaaatataaaatcaggaagtaaatttaataatgttgttagttatgaggccaaaatgcaaaagattaatcatttgtatacactgacaccacaaattttaaataatgaaagacagttatttctagtatcattaaaaacaaatctcacaacaggagtataaaattcctatacaaaaacatttttgtatttgataaattaatcagaattaaaggcctaaagaagtgaagagagaattcacagtttaaagtctgtctcctgaagtcagttttccccaaattggtatatacccaatgaaatttcaatcaatattcaaaaatattgttacaggaactgaaaggccaattctgaaaggaaatagagaactaagacaactttacaaaagaagaacaagaggatcaggctagctctatcagatagcagcatgcattaaaaggttataatttacagagcatgatggtggtaaaagaaaatgttccatctctgtgacaaaatccccagaaaaataacttgaagaagagtttattgtggttcatgatttcagctcagttgcttggctctgctgttataggccaggggtaaaatggagcatcatatatcctagccagggactgaggtgaagcagagctatcaatggcatccaggaagcagagagaaagagccaggggcaagagacaaaatatatctttctcatggaaactcacaagacactgacttcctcccattagaccccacctcctacagtttctaccacctcccaaaagcatcatgaaatgagattatgcttttatcacatggcctttggaacacaatgaagagtcaaaccatatcaaacaccaaacaaaatttgtcaattaaaaggtatttagaattcataaatataatgatacacacatgcatatatgttaataagttgggaatcaaaggggtactccagaactggggcagcagtagatgagaacaggttatctttttgtttatggatgtaggtcaagcagacaactgagggaaaataatttgatattcacaaaaatcaattcaaagtgaactgtagacctaaatataaaataataaattttcagaaaagaaccaattaactcttctatagccttagaatagactaaactttttaaattcaagcaaagcgaaaaagaaagcaagaagaaacatttgtggtggtttaaataagaaccacagactcacaagattaggaggtagagtactggtgtagactccgaggtttcaaaagccttgatcattcccagttagcaccctctttgtcttgtgcttgtggatcaagatatgcactctcagctacaactctagcaccacgcctgctgccatgttcctcaccatgacagttataacccttggaaacagtaaacccccatataaccatttcttgtataaattctcttggtcatgctgtcacatgagagcaaatatgaaagtaagacgatggggaatgtagtgtgtatgtttatcttattgattgttaaataaagctctgtttggccaatgaaacagcaagttagacaggactaggaatcaaagaggattctgggaaatgtagtagagaagtggtgctccaggccagaagtgacatagcaaggagactcatatttaagaaaggagaaacaggaagtgtcccttttcccctttacctcctccagtggtgggatgtgatccacaggcaagagtgccaacaaaaggcatcttctataagataagtcttataaaatatatagatttatgataattgagactgagctaacagatgagaatcctagtcattggccaagcagcattgtacctaatacaagtctctctgcatattaatttgggacctaactcgggtggatggctggcgtaaagcacacatgtggcgatggggcttggcagcttttggcggaaagatttatcataataagacaacatttaaaataaaaaatacccacgaactggactaccttataattaagaacttatactcatttaaaacaagcacattaagaaaataaaaacacaaatcacaaacagaagacattttcaagatctgtaattgtcaaagattgtgtatttagaataaagaacttctaatcagttgagaaacagaaaaaatggttcagtatacaaaaatattcagaaaaatccaactaactgaaaaggagctcagtaaacatcaggaaagtataaattaaaactagtacaaattaaaattcaagactggtgaaaagagaggctggctagggaaaaggctcggtaggtaagtgcttgcttttcaggctccagacctgaattaaagtcagagtccacataagaaaagcaggacttgggcaaacatccttgtaatttcagcgttggggaggtggagatggggatctctggggcttcctaaccaatcagcctaggctatttggcaagttcaaaagaaagaaagaaaggaaggagggagggagggaggaaggaggaagaaagaaaaaataaaaaagaaacaatactcaaagcttgaggaatgatatcaggtgtccttcggcctccacaaagacatatctgcaaccacacagagaactggtaaatatgtggagcaaactgaattttcatacattgctgatgggagtcaaaaaatcactaaacttcaaatttaaatataaacacaattcttggtaatttaaccaactaaaatttgtgtaactgagcacaagaaccatgaccaaaaaaaaaaaaaaaaaaaaaaaaaaaaaaacaaaaaaaccccaaaaaaaacccccaaaagcaacagtactactcctagtgaccccactagccagaaccatctcagatatctatcaaaataatagatatatgattcattaaatctgtcaagtgtatctgtaattaaaattctatctatatgtgatgatacagacaaattaaaaaacatgaatgaagcacaaaagaatatgtggttcatgatctttttaaaaactaaattaaggaataaaattaaagacagtggttatctttcactatctttgaggaagagggagggacaagactttttgggttctagctattcccatttctcaacctgaattgtattacaagaatttttcactttgcaatgttgcacttggcttgttttcttttgtgtatattttataaacaaatgcaccataaatatgcaaatgcactaaccagttgcttttgtaatttctggagacattggtggtatcatgcagtactcatgtttattaacatatcattttctttactaaaaatccaatctgtcaaagaaaccctccggtaacctgaagatataaagatataatcttatggatttttttaaaaaaaaattaaagatttattgtattttgtttgaggccaatctgggctacacagaaaaatctatggccagatcttctcaaaacaacaacaaaaaacaaatggagcctgtgagaagtaagactgacagaagtcaatgaatatagagaacatgagaggcagacagacggaggatggacgacattcatctgtatttcagcaggcagtgaggtggtatggctagggcaacccacagctttaactggaacatgaagttttcatctcttcataccaaccttacaattccatcctcccttttcctgaatacacagatttcaaggctttgctgtgtatttgacaacttcttctgctctacttgtcttttaccattcagttttcaatgaaaatacattgtcttacttagggtttgctggtatttggaaatcaatttttaatctaagaattatggttgctttatttttccaaaatgcatcttctaaaattcagataaccctccaccaagcaaaactgagattgtggctagttactcgtctttatgcagtgaggttttcctcacttcaaacctaagcaataacattattgttgtagtgcagtgattttgtgtgtgtgtgtgtgtgtgtgtgtgtgtgtgtgtgtgtggagaaagagagagagagacagagacagggcgtacacagggcatttaacaggtactaattaccgtgctaagggcttcatttgtatcatcccaattaagtaccacaacaacatagagttagggtgttcttcactcaaaagtgaaaaacaaatgaaaacaaaatcagaggcacaggaagctaagaattttacccaagatcaaacttaggaagtgtgagagctagacaatattcttacagaaacaaatttagagattatgtccttaacctctggtctatgatgcttccaatacagggctcagcatgtttccccaaccttccctgttgttctctccttgttttcatatctctacatcctccttaggttatttcttacctatgatggctgtagctaactgaactgtaatccttaataaacctctataattctgttcaaggcaaccttgctgtctgtaaacaacgcatacttccagtcccttcaatgttgcaaatatgtgggatacctacaccattcttatcagtaaacatatcgatacgtcaagtttctgtccaaatggcatcttcctctggccatgatttaatcactgtgtaatagtcaatgtttgtttagcaccatatgtcagatgctattctcctttatacctcgatgtttactcaataattccatcaactctacttggtaactgaggcgaacgattcagcagttgccgcgtcagtgtatttatgggatttatgtatctccctccgccaattacacgctgggagaacaagaaaatctccatccctacaccatctatgtttgtacagcacctgacacgtaataaaacagtagctcaacaaatatctattaaactaatgaccagagcagtgcctgcaggtcctcaactgcagatttggaaactctccctggcccatcagccctcgagtttctctgagcacaagagaagcataacaaacctatttcgtgtctagctgcctccgatgcacgcttaaggaatctacgagtatttaccagcggttctgcttcgctaagtacatacataatctcatgtacatcaccaagcattctgtgaagcggacttaagttttccacatatttccacgctgggacccaaccacaaccaaaacatattagtaggtcaacgacagcgacattgcatcttacagatgaatttttccatcagggcatagggcgcttacgtgggtctctcagtaagtcggattctgtggccatttcgatattttagtttggagttttcatcacctttaccgattcctcgcagggggagtaagatattttttttttaacaaataaacaaaaacagcctcccgctgaggaggcaaacaaaaagctaagggctccccagggcacgggaaccccggcgcggagcgcgggcgtcggtaccttcgtcatcgcgctgcctcaggctgcggcaggtgattggttgtctgtcaggcgctgggcggagccctaagcgcgctgggggccgagttgccctcttggcgccttccgcagtgccgcggcgggtttaggagtttttcatattttaaaaataatttgtatataagacagccgaaaactgactgacgggagcaggcactagatacatattttccttgctctccgagtcttggtttcgtagacaccatgcgtttgtggggcgtgtgcagggagggctgtgggtcctggggtgaggtgactcggagacccccctcaagtgagcttggagctgtcgcttctgggtctggaagaagtgaccctcctgctcctaggaaagagagctgttgttgaatatttaagccggtcacgtagtcaggttttaggctagcctgcaaaccctgcaggtacttcaaatctaaggaaggataaaattttgcaataaataaataaaacttgtattgatagataaattaccattcccagttttaagaagtggtggtgtgtgaatttgagccgtagagcttaaaacacacaaatacacatatacaaaaatactggagaaaacgacattagcaaaaaataaaaaaaagttcactagtagtttatcactggctttttagagccttttaaattgattatatatttacacattgaaataaagtttcactaaacatgtcctggtcctgagatggctcgcctgatttgggattcccagcacacataaaaagccagacagggccctgtgagccagtactggggaggtgcagacaaaaggttgaggggaaatgggtgctctctggccaggagcctaaacaaactggaaaatttcagggtcagtgagacactgtctcaaaagttcaggtatgttaataagatttatttttctgtgagaaaatacctggtgataaaaaagttaagaaaatgtgaacagcatttgagaatgacaccccacctcaacctcagcccatacacaggagtgaacactctcccacagggacacacacaaaaacaaaacaaaatgcaagtatgttctagatgaagttctgttggactttctgttcaacaacttaagttttgtaaccctgtacccataatctagcataaacagtgttagctttgttcctctaaaaactagctttaaaatgtctatatgtctgtaatagctgtacaaaagtttaaattagctttgaataagtggagattcaacctggtctggtttttagtgcccataagcttaacattaagttacactgattgtgcaagctccacctcttcagtgtagaatactttctaatgaaacttctactgactcccctcaaagagagttccctacatttgaatgctgtattgtaatgtaagttggaattggctaagtagctataaatttaatacttattatactcagcattaataaaatatacatggaaaaagcaaagtataacttctatataaaatgcatgggttttgtgtaagttgaatagtgaaataaaacttttatgtttatacttaaagtgtttggttttataccatcatggacaaaataaacatcatttgaactttcatacattgaaatattaatgactgatttcactattaattttaataagttgacactaaacacctagtatcctgcaaaacaaacctgaacaatataccaagagtttaagcaagtttcaaagctagctcatcacaccaaggatttgagcctagaaagtatggcttcaatatcacaacctttagctaccattaacataaattatatctaatgttttaatgtttatagtctctagttgaaataaatgaattgttgctttacatattttattatctcagtgatttacagttcattttcaaaaggttttataatatgtatcactgaattattcttcctccttaaaataacaaaaggagtaaatgaccagacttctatggtatgattaaaagcgttccaatattcgttttgtatgtccttgaaacattttctcttaaaacttgggtttgtcagtttcagagctccatgtccctcctcctagaacgtgtgctaggcatagcctaacaaggagccctcctctaagaccttgcctggagaccacaaccaaactagaattaacagcttccaggtctattctactggtatgtccttttatcttctcttcaaagtctgtcagaagctcctacttaaatcattttactttccctctgcctccagctagcatggattcctcagacttcacttcctccttccttcatttcttttagaaatgtgtggtgcagtgcagcttgcaaactataaagaagatgtactgtagaaaaattaaaggattttttttttggaaataaaggaaattggaaattttcaatgacaattgttttatgaattctttaaaaccttttttaaagcttttttttctcttgaatgaatgctccaggagtctgtctctctttttatttccttatatagaaataaaagattgaatttttaaattgagaaagttgtgtaagttgggaaagataaactaaaagtgaaaactattgagtaacaacattgctttaagaaagccagagcagggggtaggggatggagagggagaagggattgacatctgaagcaagcttattcctaatttgaactaataaaataaaataaaaattaaaaaaaagaaagccagagcagctgatagtaagagtgtgtagtgggatagggaacacctagtaagagtgtgtagtgagatggggaactcctagtaagtgtgtgtagtgtgatagggaactcctagtaagagtgtgtagtgggatggtgaatacttagtaagagtgtgtagtgggatggggaactcctagtaagagtgtgtagtaggatggggaactcctaggtaatgttaattctttcagaatttcatacaatgattttggttatacttctgcccttaacttttcttagacccattcctgcccctttgctccattccaacttaattttcttttcaaataatcactgcatctggtttgtgatgctaatatatactcatacatagggggccatgactggatctgggtcaatgtaccaggggccacatccttaaaggaaactaactcttcttcccccagaagccatcaactgtcaattgctcctcatttagggattagatgcatttgaatctctttctctttcatactgaaatgttggctgtcttgatcttgtacagatcttgtgcacgtagccatatctgctatgatttcatgagtacaacagtcctgtcatgtccagaacacactattttgttcctgttctccatgacttctggctcttacaatctttctatcccttactccttaatgttcctgagccttaggaaaaggaggtgatttagatgtcttattatattaatacatagcatttaacaagacattgatgtaactgacacagtgggtttcttctgcttaaaactgtacactcagaattttagttgtagacaccagagcagtatacatttgacttataaatatctcctagtcaaagcattctagcttagactgagataataaatacatatcatgtggtataagttattctaatgagagtggaacagtgcagctgtgatagagaatgccaggattactccaagtgagaaaggccatgggcaattaagatacctatttcatcagcctgtgtgccgaaacagaaagtcaggggtgaagtcttaggaaatgattaagggagttgagaggaggtttagttgtctatgagcttgttattttcagattgttaacaggtcagcaagattatatattttagtttaatttttaaattgaaaatggatttttttcccatctaataattccgatcacagttttccctcccttatttcctcccagatcctccccacctccctactcatccaagtccaccccttctctctctagaaaacagaacaaagcaaagccaaaaacaacaacaaagaagtgtgagaagcacgtaacacagaggcccacagaaaatccataaaaacacaaaatcagaagccatataagtaaaagaccaataagatttaaaaaaaaaagcccagataaagcattataagacaaagcaaaacaaaatcaatcaatcaaacaaacaaaaccaaaaccaaccaaccaaccaaacacctccccaaataccattaagttcattctgacttggtcatctagtcctgggcatggtgcctatccttaaaagtggtttgtatgttcagtgagactccaatggagaaaactaaattctcctttgtgagcagttgtcaactggaaatgactttttctttaggggttggagatcatgtccactttcccagcttagtgctgggaccccatctagcttgaatctgtgcagatcctgtttgtgctgccactgtttctgaattcatatgagcatcagtcccagcagtgtcttgaaggccttgtttccttggtgtctttatcctcactggctcttatgcaatctgtttgtttctgcttccataaagttctctgaagtctgaagggaaaggtttgatggagacatacattttagactgggtgttccaagctttttcactgtctgcacattgtccagttgtgagtctttgggttcccatctaccgcaggtggaagcttctctggtgatgattgaatgaggcactgatctatgggtatagcagaaatgttgttaggagtcattatattgctgtatttcttttgtaagaacagtagtatttggttttcccctaggtccatggcctatctggtcccatgttcttgaccacctaggcagtgtcagacatgtgggccttaagccaaatcagatattgtgccaccattgtcctagcatatcttacaggcaggataccattgtaggacaaaggctttgtggctgggttcatgtttacatttctcttttgttgaagatgctggtttttttttccactctgtatttctggcttctttatcacaaatcaggtgttgattggtgtatagatttatgtttgagtcttcgattctcttgaagagctacaggcaattaatgactgccaagagaggaagagtcagtcttccccagggatgagcctactaactggttactcaatactaaatagtgaaccctaaaaacatgtatgagtatatgaacaataaatggactcagcaggtagaatttatatattaatatatatgcattaatatattgataatagaaaaagaaaacgagagataatacatgaaggtagaagaagggcttggaagtagaaggggaacattgagaggtgaacaagatatagtaatagggaattgaagattatcagcatatattatatacatgtatgaaatgtcataataaaccccatcattttgttcaattaaaaaatgctatgaaagtggaaaatatttgcagataattgatatacacacaaataatgttaccatctgttaaaaaaaatgttgtttactaatgaggtggatatatttacttatttttgcaagaaggattaatcttggctaaatatggaaaataaacttgtataattatgtacatttataatttcttcagtggacttagttataacattttacaatgatttttgcaaaccacaaataaacagagctatgtcaagattaaaagtcatgaatcttttagactacataatttgccacaacccagatggtcgtttgactcctaggatcttgttcttgtcactctgctgcctagctgtctcctgtttgacattgcaattttcaagtaaagggcattattatatgttgttaaccaatttgttttaatttgcttcttcagatggattttaaaattgaatacacttgggatggttttccagtgaagcatgagccagtgtgtgtcaagctgagttcaggggacaagggagtgaagatggaggttagtgctccatttttcaatgatcctctaactcctcttggagaaccaggaaagcctttcagtgaactgtggaattacgaaggtaagtagaagtattgtattttattacaaacataaatctttttctaataacctctcagagaactattattttatcttgctgttaggaagtaatatgcttctgaacaactgacattcagtttctgatcttgactacccatctgtcattgtgacttccctcccattaccaatggggctccaatatatgagcagaacagagaaaaatggcaatgccaaatccagatgtttgtgttgctgccatgtttccttcctttacttgcgtcatctgctctagaaagagttcgttttccccattttgttttttaagaatctttaaattgccacttttacctaaataacctcctgtatgggaatatgacaatgtgttacttactggagaaattctgtcagcataaggtttaatatttactttttgctctcaagtaatctcacatatcaaattaaggctgaaagacatgacaggaaattaaatggttttaggtttgttctctgactgtcttgtactatatcctcatcaagctgcagggttctttctgaaatactattcgcgatgccatccccatagatataaaatactacattacatagaaattaagaatttatcccaaaacttctcactcagtgtattgggatttatttacttagttagcacagagccttgcttctaagtaatctcttttcctaagtctgtgtttcactttgaagccagaaggatttgttaactctctaaatgaaaaatttaacttacccttcagctaaggtttttaacgcaaaaaagcaaattgtagtcaagtatgattttatatttattttttaaatatcttaagaggtaaattgtttgtagaagcttagaaaaggtctggcaagttttagtccaaagtagaaagaaaaggactgtggttttcacttcatatattttgtgctgttgtagctgtttacaagaaagatgcattacaccaacaattaattaatttttaaagcaactcatcttcaaaataaccctgaaattataataaaaatcaccacttacaaaaaccagtagttttttaattagttttttttttaaaattagtttgagaaaacatttccaaacttgtggaggtcaggggacttgtgggagctggttatctcctcccaccatgtggattctggggatctaactcagatcatcaggcttgagccaccacactagccccaccactcttcatatttgttgtgcccttgttgtagacaggtaatcattggcatacacattcaaatgcattacatatttaaatccacatttgtttcatggctcatacatttagttactgctttatacatatttcactgtctttgattttaatagcactgttatattctattgtatggaatgcatgcatcctgtaatgcacttaataagttttgctgaataataggtgattcatgtaccaggaaataattttatataagaagagatagctatttatatcattcctagttttttgagtcatactctgatgggtagaattgtacttaatttcttattctagttgtctgatttgtttctttgggataaattccaagaggaagataactaggctaaagtctatttgtgcagacatgttgatttccctatggcctcaccatcactaggctttgtatttcctttgaatttatggcagacttctatgggagaaattgagggtgacttatttcctatgcttttcttccagactttgtatttatttttcttcctttcctactggggatagtatgatgatttaagaaacttagtaattcactttatattagaaaggaataaattatttactatgtaagcaaaataaaatttcccatgttttgtctgttttcctaagttgtagaagcatttttcttgaatgatacaactgagcagtatttagaagttgaactttgtccgtaagtataaaccatttttttttaaactattactacacgatttgaatatatttgttttctagttataaatagtatggttgtagtaaagctcactaagttgagctatgtagtggtcatattaacatgtgtcaattttaaatctctattgtcttatacaatgcatacttttagaatttatgtttagactatacacacacacacacacacacacacacacacacacacacacatatatacatgtttgagtatattatgttgatgtgatttttttggcttattgatataaatgattttgtaataaacgtgatagttttttctacaaagtggaaaaaattactatcaataaattattactttatatgtttgtactattatatattaactatttagaagtgaagggagagttcctatccctaatcaagacattatcttcatatctagtttattttatttgccagtttgttttctaaagaaagagagaaaagtgtgtagttagataggtggggtgtggggaggatctaccaagagatagaggaaactgatcagaatttattgtatgaaaaagtttattttcaataaaaaatgggagacataaagatataatgaattactagcttacagaaatgtttcttttagatttttgaatgattaaacttgaattttatatattatgtaattatgtatttatgtgttcatctagttgtcattcattattttgaacacgtggtatatcatttttgcatttaatgccaagaatgtaatttaaatcatacctgaactttccaagactcacagtaaaaatattacctttggactttttgtcttgagacaggttctcactgtatagctctggtcagtctgggactcttggggattaaaggtgttagccactacacccagttgtcttggaatttctttgaacttcaatatttacgtgggaactttctttacacggtgacaaacattttttctgagtagatgtaagataaggaaacttatgcttacctgttatctaaatcacagcatacttttaatacttgtgatgtttctatatattgcttttatttattttagatgccacttaaatgtttctcagtatcagtgtctaatagtctttgttccttagtagactagttgcaattaatccacatgaaactttagatccccacttgttagttgtttgttttgctctttgctaacgctaacatggaaaatgcagttatttgcaacttgtttttgttttgttttgcattgttttctgagactaggtctaataatgcagccctggctaggatggcattcacaaaaatcacctgcctccaccttcaagtgctgggattgaagatgcacactaccatatgaggcttgcaattatttttaaaattcagaataattagatatattttcacattatctttcaacttgcatgttaaaatattttatttaaagccatgattagttcttaaaaacggtcatgaaaagtcggacaattttaactatcatgtactgacttttgtcccatagcagagaaaaacagctaagacaaacatttttaatttgactaaaagacaataaagaacttggatgtatcaaaaatctcaattttaagcttagatttatttgtcttacattttaaaaaagtacttattcttttattttagatatgtgtatgtatgtgttcatgtgtgtaagtgcaccatgtctaacatgtagaggtcagaggacaaagtgcaggagtaagttctctctttttaccaagtgggttcttggaattgaacttaggacatcagacttggcagcagtctcctctacctgtggagccatctcactggcctctgcaattttgttttgttttgttttttattagattgtatcagattactttcatgaagtgacaatctaacattggataaatagaaaaatagtttttcattacgaaactacatgatagtcattgtgtataaaagtttttaaaattaagatcctcagggtagtttggtttcatatacatcaggatagttaataatcaagaatcatggttttgcctcaggcagtcaattcctgtactggttaattaacagctagaaaaacagcaagaagaacattgttgtaatttgcaagaagttttacgcatcctaggatctttccaaagcccaataaaaacagtaaaattaatcagaggatttttaaatggaaagcattacttgtcttctgttagagtactttattgcagaaaatccttgctccaaaagcgcacaaaggaccatctgggtggaaatgtttgatagacttccagaggcggaaaatttgcttcatgtaaatacatgcaatccattgcttcttacagactccgataatcccacttactcattcccattagaatttccttttgaaatgtattatgcttgcttttggagatttgacattggtgcctgaacaaatggtagaaagctggaaaacagatggcaaactgttcaaggatagcagtgtgaaaaaacagacataggttaaaaatctctgccttgttctctagttttggtcaatctatattttacatcttctaccttcctaatgggcctcaaggaagtttcttacagaaataaccattagttacgctgttttgttaggacttggaaatcagccccagctttccttggagtgctttagttgttgcagctgtttttattttaaactcttaagtatcatgattatctctttttttcttacattgtgttatctaaccaaatgaagtattttatataatttcctgtctaaagaatatgaaaagcagggcccagtgaaattgctcagtgtgtaaagaatatgaaaagtagtgttagccagtgaaatgctatgatttgtcagcagttgtttaggaaacagtaattccaaagttgtggttcctaaataatgtgacacactagctctccctgtagttatccaatattatattgcactttttatttatttggaaatttagctacaagcacatacattacagttagaaaggaaagaagacaatattgtttatcttgtaacagactatagaaatgatccctgaaattacaatcttgatcgtttttctttaacactcatgaggaatcttaattttacagacatggacagcatttagttcttttactctctggaagaagaaatgtttggaaagtgagtaaataaacatatgaaactaaatcctataatgcacagcatgtgtatctctaagtttgaacttgcctttatgtttctcatagaaagagcttccattatcattcaaagtgttcagaggagagacaaactgggaaggcatagcttttcttccttggagttattttccacccaatgtgacaaaattcaactcatttgccattcatgggtcaaacgatcaaagaagttatgaagccctgtaccctgtgccacagcatgaactgcaacaaggacaaaaacctgatttgtaagtagacaataaatggaggtacattctaactacagaattttgggaactacttttttgtttattttttgtttagacagagtttctgtgtgaccctagctgttgtgaaactcgctctgtagaccaggcttgccctaaactctgagatctgcttgcctctgcgtccctagcactggaattaaaggccaccactgcctggtggaaattagttcttggaagagcagtagtaaaacttggtagttgagaatagcatatgtatgagtacatagtaagaaccctgtgttccctcatgaccctcaacttttgaccaagatagagcatctcattatttgcagcaaaatacttagtctttcatgattatataagaagaatattagtgagtatacatcagctgatactgttatgccttcaaattaatttatggtcgttttcctaggtattataatagccagagggatctgtgttttgtagtgtggctagagggattataaatttttttctttgttactaaagaacttgtacttagtcacatctctgttctcttggttgcttcgtaagaatgtttctaggtaaccatgcttgtgataaaatgactcaattggtaaatgacatctgcattaagtaattctgaatgatctgtaaatatatgatgtagacagtgtggcttagggatttctctttaacagttatgttatctgtggggactcaagtttatgccctctgagtggttgtcagaggtcatgactgtgaggcagcaaatattaagccatagtatcttcaacacttgtctcattttagccttgtttcctggcatctgaacctgtcatgtaggaataacatagctcatcgtgtgtcttctgaatgcttcatgcattactgtgaggactagtcccttaaggagggaaactcagtactcttttagggcagactttggtttctgctgtctcttggtttagtcagtgtggttagcactggggagtctggatgcttagcagagcctagcaaagacagcctagtctttgcttactagacattcctgccctttttcccttagaatatgacaccacctttcttctccacgttcaacttctcttgcttttacttgcctttttccccttcatttcctctagcagatacctgtattctgcttgacacatttaaacatctacttttgcctttcaccctagtcctgactcgttctgcctagctttttttttcttttctgtgtttcttccttccctattgatccttggcatcttactctgggatttattgatgtaactaaactggttcatcctggccaggtgggcagaaaggaatagaaatctaggtgccactgactgagagccatcatactaaggtgatgtgccaccattgcttttcacttgctagtacctttccagggaaatatgaatgcacattgatagggaggaagcatggcagagcgatttcatatagctcagagctttactgaatcacaggtaaaagcctttctttactcactaagccacaagagaacgatttagaataatgatgattattctgaaatgaaagcacgattatcactcttctatgttagcctcctttactttggcaaaggaagaacacacatctgtctctgtcctttattcatcataacttatgaaagtttgaatataagaacatattcaagaacttaaaattggcttacagctaaaatgagttagactgttgtctctttctcttcctccctccctccctctctctcttcgtgtgtgtgtgtgtgtgtgtgtgtgtgtgtgtgtgtgcatgtgcaggtagagtcccaaagataccttcatgtgttgttcttttgcagcactgtccacctcatttgatacaaggtctcttattggccttggagcttaccaagagtaggctggctggccagtgagcctcaggtatcatcctgtttctgcctcccctgtactggatttacaagtgagcaccactatacctggcatttttttcttttgttatttgaattagaaacaagattgttttacatgtcaatcccagttcccacttcctcccctcctcccctaccaccccccctaactaaaaccctacctatcacatatcctttctactccccatagggggtcgtcagaggatagggcctaggcccaccaccgtgtatcttggttcaggagtatccctgtatgttacacctggcatttttatgtgtattacaaggattgaattcatatttctttagcagatactttactgagccccttgagagctgatatttacttttcccttgagctgtgagggaacgatgtgtagcattgaagaagactgttttgaaatatgggtgaatgtttttagaactgagtatttgatagctacaataagaaacttgtacatagagaatacatttaacatttgttattccttaaaatggaatgctgtactatcaccaatgtgacaaaacaaatagctctataggaccacaatttcacaaatgcataattcatttcagtttctttcttcctttacttttagccatcgtctagaatatttcaagcctttcagttttaacacactgcttggagaagaatggaagcagccagaatcagacttgtggctaatagagaaacctgatatgtagaagtatagtagattaccaaccatgtcaatcatttctcctttgtaccttttaaggtaatctaataagatatgtaaacacaataatctatttcagttgatgagatggtctatatttgctaagacatcaggatagaagagttatttaactagatatttttactgtgtaggaagaaatgaaatattcttgaatcctggaaataaagttgctacttttacttacagataagtagtattttcttaatgcttttagccaagatgtcagaaaccttcatttgatttttgaagtgtcaaatatttctggttgaaaatagactcaaatataataaatcaatagttcctctcacataaatgaaacatgcagacaaaaatgtcaacataaggagcctcagagtgaaactgcaccacagatcaaatagacacagctgcagaatgttccaccaacagctgaaaaatgaactttattttcaggtgctcatggaacactttccagaataagactagtaacatgtttgctgcaattatgatggctgtagctgcttgggttatctataccagaagacttttagatctgataaatcaattcagccaagtggtacatagcacagtcagcatatatgcagaaataatagcgtttccacccatcaataaccagttgctgagaaagaaatcaggagagcaatttcattcacagcaaaaagaatatctaggaacaagccttgtgcattagttgcttttctcgttgttgttacaagataattggcaaaaataactctgaagggaggatacagtccatcatgatgaaggaagcatagcaacaagaatgtgaggtgactggtcacattgtgtctacagtcagaaaacagtaaaaatggctatcctcataaaaataacaaatgtcagtgaaggtaaggaggagaacaggcccttgttcactagtcataaggattcgtattagtcctgttaactgtggaaatcagtatggagattcagaaatattggaaatagagctatcatatgatccagttctactagttctgagtacatcccagagggaatccaaatcagcataattcagagacacctgcatagcttcatcatcacagtatcaagctatggtataagtctaggtgtctgtcgattgataaatggataaagaaaacacacacacaaaagaaacagaaatgacatactgttcggccataagaagaacaaaatggaagaaaattaagtcagactcatgttttccctcatctatgaaagttaaacaaaacatctgaatataggacagtagattgttagagatgtggaagatgatttgaggagaggaaagggatggggaaaagatgtggtggggaataaaaatgtctacagttgtatgcaagtataaatctgtgaaagtaaaatccactatgttgtgtaattaatatatacaaattaaaagtctagaactctcaaattttgtactgtgtttcagagcttgccttctaatagatctgtgaacttctgcatcatatttagtctttctcaacatcattagctcagaggccagactcacagaaggtaaaagtttatcacttatacactttttttgcttatcaacagtatagtttccccatctcctcccattaaaaaagattgtgtgtgtgtgtgtgtgtgtgtgtgtgtgtgtgtgtgtgtgtgtgtgtgtgtgtgtgtgtgtgtgttgctattgtctacgtgcatgtggaagaccaggaggccagaagaggctttgggatccccacagctggagtgataaacaattgtgagctgcctgatgacatggatgttaggaattgaactcaggtcctttacaagagcaacaagtgctcttaaccacttttccatctctccaatccctcctctcttctttaataaccgaatctgaaattttggaggcttttcttggaaatgttatttccaaaaaacaaagcacccctgtattttcccagcttttgcaggtaatatggccatggaatggtttgtgtcaatgagatgtacagtcatgtgctgtataacaacattttgattagtagtagactgctggttctgctttcataaagctttagttgagctaaaatgtgataacatagccattgtaatattatggcaaaatgtactatatgtctgtggtgatattttacataaagaaacctactgaagtgccagttgtatcaaatataacaacgcaattgtgttcagcacaaaatgcttgacaatgatgataaatgactgtgtgacttgtttatgcattttgtatactgtacttttatcatcattttggagcatattccttcggattaaaatttttatggtacaataatatgttttgttatgtaagcagcagctttaagcccctaattttgagggcatttcattgatagcattaataggtcacatcagatgatactgagttaacataagtgtacactataaacttgcacttgagataaaaatcaaatatggatgtgtctctgagaaaatgcccatgctgttgagtgacctgaggctgtatttggtcttaggtggggcttgaagaaagttatttcagtctggagctatacctcagtggtggagtatatagctagtatgtgcaagaccctcatttcaattcccagcatggtgaaaagaaaaatgttgaaagaagaaagcttttataaaagctaactcagtactttttatcctttgcctttcaattgctagtctatgaatttacacagcacttgtgacactatggagacaaccctgggagaattttgtcagaagtcagaggaagcacagtagtgtcatatatcagaactgaactgcctaccaatagacttgttacatggagaaaaattgtttaatatgttcacaaaactaaaaaaaaaaaacctgtctctatcatatttagccaaatgatattcctaacttccagttagatagaaaatgtaagttgagttctcttcctaaagtcgcatacagtttcactaactatctctcttatttggcattgtatgagacattctagccagttcaatgaagggatgatagatgaatagaagacaggtgttacaaggaaatgagttaaaatattttcaaatgtgcgatttacatttaaatgatcataatttaagagctggggatgtggctcagtggagaacacttatccatcatgtcagaagctgtgggtttaatttctagcactatagtaacttataattaataataaataaaatcagtggctggaggggtggctcaatagttaagaaaacttgctgttcttgcaaaggaccctggttcagctcccagcacccatttggtggctcacaccatctgtaacttcaattcttgaggatctgatgcctttttctggcctctgagagtatcaggtatacacatatatatgtgcaggcaaaaaattcctacacaaaatattaatacataaaaatgattatagttcataaaattgatgcatttacaacagatttctataaatgaaagtaaatttagccaagttgtattaacacatggtcaatatatgagtatattttatatttctgtctattataaacagttcatagttcaaaactaatatcatataatcaaaacatgaaaaaactaagactaaatttaaacaaaatttacagaacctctatactgattagaatcaatattattaaattttatgttaatggattcatatcaatcccagtgagaaatctctaaagatttttgtgttgtctgtctgtgaaagaggggaactgacaaatggattttaaaaaattgtatggcaaaaaagagggattaaaactgatttaggccaggcattggtggcgcacgcttttaatcccagcactcgggaggcagaggcaggtggatctctctgtaagtttgaggccagcctggtctctagagcgagtgccaggataggctccaaagctacacagagaaaccctgtctcaaaaagccaaaaaaaaaaaaaaaaacaaacaaacaaaaaaacaaacaaaaaaccaaacagataaaaaactgacttagataattctgaaaaagaacagagttgaaggatttatatctgtaacaggaattaataaaagacccagagactgatattggggttcaagctgaagatcagggaagcaaagcagccaagctaccagagagctcttacctctgatagtctggggagttcctattttcaatgtggctgaagaatgaatgccttatactgactactgaagaccctgctcctatcttttatactcccatagtgttggaattaaaggcatgtgagcctaggtgctgagatcatctttgtgtgagctgtttctctttaggactggatcaatcttgtgtacatctgggtggcctttaactcacagagatccatctacctattaatcttgagtcctaggattaaaagtgtgcaccaccacctcctagcttctggctgctgggattaaaggtgtgtgtctggtttctatgccttgtggctttctgaatccttaggcaaactttaataaatcataagaaatatgtcactacatatatcaccagatttcaacaccttttattaaggtttggtcatgaacacagaatgacattaagtttatacaaatacacctgtaaattaagaaatgtcatatatgggaaagcatggggaaaacaaactttgccaactgattaaacatcaaattccagaattaatgtgaatgtgactgttgagataaaaaaaaaaaacataaaatctttatagatcaggatggacattttttcccaaaacagtccacaaaaatcactaaacaggataaattggacttcatcaaaattaaaagctgataaaccagggagtttttcccataagtaaagcatttgctgtacaagcctgctgatctaaattcaatcctcagaacacacattagtttttaagtgtggggacagcctggagagatggttcagtggttaagttatttgctgctcttgcagaacaaccaggtttagttcttagttcccatactgggcagttcacaacctcttttaactccaactccagggcatctgacaacatgcctctgtggacacttgtatacacacacacacacacacacacacacacacacacacacacacactttgattattgtaataataacctgctgagtccatttttgttgtttgtgtgtatatggcttcagggttaaccacttagtattggattatttacaataatccaataaaggtcttatccctgggaaagtctagttcccattctctcagagatcattagttgtctgtagtttttactaggtggttccctgtgaaattttctctgttccacattagcatgtctattgttattgcattgttctggtcttatttatgcagctatttctaagtgagacttttgtagcagccttcctagtattctggctctcacagtttttctgtctgctcttctgaaatgttccctgaattataaatggaggagctatgatgtagtcaacttttgtaggcagtattctctaccccaatgctgcacctttctgtactaatgtgcgtagcattcctctttgtcagagggcttcactttgctgtccctacttaatgcctctgacattattcaagggtagaagccatatttctcagaatcatttggtgtgatggtagagacagtttttccaactccctgtaacatgctgttaggtatctttcagcagactacaaagagcaactatttagtatttagttttcgaatcccaaaccaaggagagcttttctgggtaaacccacttgattgctccctcagccctccaatctgcatatgctctaggaacaggtattctagtgccaaatgagcaactggatcatgatgtcatgttgtggctttctataccaacatctttgtaaatctttcaatgcttttatctctcaaggacttaaaataacatttaaaacatgccctcgtgataaagcacaacattgctcttttagaagtaataagattttgccaaaactctaatagcactgttagctctgagcttcatacttgcttcaaggcttctgggagggaatgactaatttctcacagtttggagaataccttaagttgtttcagaatttcttatattgagatggatgtggatcctagctggttatttgaatcctttactcctcttgaccttaacaactcttctaatgacttaattagcttgatagtgtcaatatgctgcactaaattgctcttgagggttattttggccaagagactcactctctagaccatagcaaacatgccaggaaatttacacattgctgtggtaaccgtgaaattacacagattttataccatgtatccatgaactgtgcctggactctgaggaggaggttgaaagaaggcactaccccatgcaaagaagcattaggctcctctttgccttcttttactttccgtagtctttgtcatagtaggtacacttgaggcaatcagaggaagccacctcatttgatccttagcagtatgttgtgtattttcagtaactacctagattatgtggtaactcgaagagtgattaaaaagaaagttaatgggaatcaaacctccctctgccatttccttaattagagcaatgatctattgttgccttattacccaatgactcatgaaattctaaaatttctgacttattataaccagttaaaatgaaatagtcagtttagccattatccttcatgaagacagtgatttagcactgaaggggtattttactcagtacgtatgtctaatatttatttatttatttactgtgtgtgtgtgtgtgtgtgtgtgtgtgtgtgggctattatgcacatatgccatggcaaatatggagattagagtagatggactatgaacttccagacagttttttctgtctccacctcccatgtccacataggaatgctgagattatagttgtgtattgccacatctatctttttatgtgagttctgtagactgaacacagttcatcagacttatgattttaaccactgagaaatttcactcccctcaggttcatttttatattcaaagaatcacagtgcatgtgtactaatttttaaagatcaatgtctcaaaagtaactattaacccttttcatcataaacagtcttaaaccaactacatacatcctgttgaaagaaactgataggaatggcttttctgtagtaaatattagtttgccaaaagatttgtcacaatctaatttataagatgctttgactggtttctttcctaggttatccacacatgaaggaagaaaatatattgccattgtcttgtatttctcagcttcctgttactatgacaaaatatatgagatagtcaacttaaaagaaggaaagacttctttaggagctgtagaccatagtttcttagttccatttgcattggacttgtggcaccatagtgctatagatattccctcctgtgtttctggtttgtagttctctcagccctaattcttggttagttcattctctcattatgctttaagaaagggaattgggggatggatatgcaaatatgagtgcctctaaaataaaaaaaatattgaaaacaacaacaaaaaagggattccttaagattcaatcctcagacttttactttctatatttgaactgatttggttacctcaaacaatatggtgattaaaaatacattcccaattatgtattttaatcttccccatctgtgccagaacatcaaacctttcaattgccattaaattatcaaataagcaatatatatttacatgtccaaaaccaaacacttggctcctataccttatctgctccaacttttctcagtttagtaaatgatgaattttcctatagcttagaacataaaacaaccaatcacatttatatgagttgttttggtgaacattagtttctcttgatgaatgtaagcttgtattcagagatcatttcttctcctcatatgaagcatcattaagtttctttaccactcaatcaatgacacacacacacacacacacacacacacacacacacacacacacacaccaaaaaaacctgttatctagattgaattttgggaactagggagctttcccattttcttctacagcatagaaggtaaaacatccagaactatgcacatagtttagctatgttatgaatagtgagaagggaaaatatattttttcagtttcctctcacaatgtagaaaaatgtaaattgaagtcccagtaaagcagttggctcaaacacaatagagtgaaataatgaaagccattcccttagaatatgacttcattctattcaacatttgatgttctactgccagtaaaatacctctttccaaaagtttagcaaaatttgctgtatgcatgtctttcttgctgtacttcagaattttgaacttcatcttatctagtcactcatctgccaattacatgataagcttctaggcaacataaattatgcctgagttacctctctccatacagataagataaacaaccagaaagtcttgcaaataattttgaataaatataaataatttaattaatatatttccacaattttaatgtataatttttaactattaaatactaatgaccagaggcttgttgtactgaaaatgttttttaaacttttgcaattatatagataagtatttcctctttattaatgatgttcttattattcttagagaataatgaatcttaaaagaataatattgctggctggtggtggtacacacatttaatcccagcactcaggaggcataggcaggcagatctctgtgagttcaaggccagcctgatctacaaagctacacagagaaaccctgtctagaaaaagccaaaaaaagaataatatatatatataataaattgatttaatataatatatattataaattaccttctgagttaggctttgtgatattggtcttatcatgctgctctgacttatatttaccacatatgtctctcatgctatcgataaataaatacatccaaagacaataagtattattaatcataaactttggataattagtgaaacttagtaccattctgcgataagagatagataaacaaaaatctttaaaaatgatggcaatcctagctgttattatagtgtactgcagaggccttgaaggatatccttttgaaaaaggtatgtgactcatttatgtaatttttgaatccaatggggaagcagtattcattaagaatgatgattttcattttttatttttatttttatttttttattagctcaaattaggaacaagattgcttcacatgtcaatcccttctccctctcccttccctccccttcaacccttccagccccccacccctcccccctctgctccccagggagggtagggccctccatgggggtggggtggtgctccccacatcccaccacattatcctgggcctgacctaggccctccctcaatgatttttgttttaagaagattctgctgacctttttcatgttatcctgtgtttataataaaattgatgcaataattgtcttattttagacatagcaatagaatgtgttggctaaattggagtaaattttccaataatttcagaataattcaaaataatttcacttcagaaggcaagaaaagagtatataaaaggtggcagatggcccttaagcactgactgctatgatctctaaggatgaaggtaggtatttggagaacagctatggctttgtcttttcctgttatctctttgtcttatcctgttatcttctcttcctcctctttcccgtcctcctcttctgcttttaaagacttttacaaaagagcatgtatggccttgggctggagtgtgggtgggggtctgcctacttcagcctctagaatgctggggttgttttagaccatctggatgcatttctttactgccccccaatctacctatagctacaagtgacttaatccctcattcacctttattgtttcctccttcaatttacttttccctcctctatttttaatctactgttcttaatactaaccactagtcttactcttttatttttatttcattattgcctgtagtaactaataccttattacaaactatatatccctgttcctctattactccagaattattagagttgaggaggaaatttaccaaaactatattttcataacccatcagttgtggttgtattttcagttagtattctgatcttggagtagtgctagaaatagagccaggtgtcctgaacttgtaggcttaaggtatatttactgaactgcaccccagctaagtgggaagcaacaaagcttcaacttcatatgactcagtattgcaacggcttcaactgaaagaataccactgattttttttaaaaaatcaaccaatatcccattctaaatgcataagtcccaacgcagaaatatgagagagataaaaacacaagccaacatgtcttcaactactaccaattccatagtaattataggttgtggtggaagtaaatcacatgaaattcttcaatgaaatcacaaagtcctgaattatttcaaagagaatacaaacatctgaataaattagtcaatacagaatatggaaaaggaattcaacaaagagatgaaagtgctgaaaacaatcaaagagaaattttagaaatgaaaatctccataaataaaaaacttcagtggaaacttcagcaatagaatggatcaaatggaaaacaaaatatcagaacttttaagacatagataaattagaacattcagacagcaatatagacaaaataatgataaagaatgtttagaacataaaagactcatggaacatcattagaagatcaaatttaggaatcatgaatacagaagaagaaaaagtattaagtaaagtcacagaaagtatgtttaataaaatcatagcagaaaaaacctccaatccagggaaatgacaattaggttcaggaagcatagatataatcatgatcagaaaagaacttctccatgacatataattaaaacatgaaagctgcaagggagagagaaacaccaaatcacatataagggaagtcccaacagagtaacagtatacatttctcaaaaaaagcttgagtttggggaagaacagaagagagcaagataagagataccataatagagggagacattataggtttaaagagaagtcaggcactagggaaatgtctggagagctacaaagatgacaccaactaataatctaagcaacagaggaaaggctatcttaaatgccctcccctgacgatgagactgatgactaacttatatgccatcctgtagccttcatcccgcagttggtggaagtagaagctgacacccactgttaaaacttgaactgaactgaaatccagttgcagagaaggaggactgatgagcaaggggtcaagaccacactggtgaaacccacagaaacagctgacctgaacaggggggaactcttgatctccagactgatagctgggaaaccagcaagggactgatccagaccctatgaacgtgggtgtcagtgaggagaccttggaaatctatgggtcctcctgtagtagatcagtacttatccctagcataggtgtggactttgggagcccattccaaatagagggatactccctggccctatccaaaaggatatgacgactctgaagacccccccatggaaggcctcaccctccctggggagcagaaagggtatatgataggtagggttttagctgggggtggcaggggaggaggggaggaagagggaactgagactggcatgtaaaacaatcttgtttctaattcaaataaaaaatgaaaaaaaaaaagccaagaggtcatctatttcaaactctgaaagacaataaacaccgaccctgagtactataatctatgaatttatccttcctaattaaagaagaaagaaaaaggttccatgataaacacaaaataaatgaattaatgattacaaagccacaggtgaaaaaggtaaacatatccatgaggtcaaagggaaatataaattgcactcaaacactagatgagcaagtgaggattaggaaagtaccaatcattacaaagacaacaatatgacaggagtaaatacatacatttcaaggataactctgaaggtttagggtttcaactctaataaaaggacagcaggccatctgatcaactcaaattagtcctattttcttggctacatgaaacacatgtcactggcaatgacaaatagcctaaggctgaaagggatggaaaaagacattttaagagcaagtagaactagaaagcacacatgtatggctatactgatacttgacaaagtagactttaaatccaaattagaagagatgaaaaagtatttcacattgactaatagaacaaccatcaagaaaataccaaaattatatatgcttagaacatcaattatatatataaaaaaaacaccactgatgtaaaggggacagattgacctcaatacaaaagcactgagtaacctcaacaccccattctcacaaatatgtttttgaggcaaaaggtcaacaaacatcagagttatatgtcattatagataaaatggacttaacatttatagaccagccaaacagttcagaatgcagaatctcatggaactttctctcaaattgacaacattttagtacacaaggcaagtctcaacaaatgcaagaaaatgaacatagttcatattgtaggggaagctgtagccagccctaagtaggaggatgctacgccccctttccccattgttgtcacttaggataatgtatatacctagttagggatagcttcctattgtttatggttgggattggaaggaggtgttcaggcttggccacctctttcagatgactttagggtttagttaaaatagataggatatgacataagcagattgttgtatcttcttatatttttacctttatgattgttaattttggatactttaaactgttaagttttaatcctcttttagactaaaaggggaattgtaggggaagctgtagccacgcctacttaggggctggctacaggtatgcctgaccacgcttgtgagggcgtgcctgaccacgccctcacaagcttgcaagggcgtggtcaggggacgaagggtgactgcgttttcgctttcagtttctcttttgggcttgcagacagactgctgccttgctggctggctaggtcgctctgtaagtaaggcttttccctattaagtacccttatatttctacctgattccgtattggtaatttcctactatatcatataattaaaatagaaaaatggtaatcaaaataaggaaaattaccaaaaaatgcacatattacagagacaaagtaacatactagtgattgatgacagataccttagaaatcaggagggaaatgaaaatccttagaaataaataaaagtggaaacaacagatatctcaatctatggactattgtggtgacatattgtttatgatttaataaagcttgccttatgacccttgtagtggaacatttaagccatggcaatggcttcaacaaccttttagctcattgcccatctttccttggcactctggagaaacaggtcacaggaaaactgggacattgtaatcactgactgccaatctgttctaggataatttgccaacattttctttgcctcaccctctccattacatcaccgcccatttccctttgcctcccactaccatatacatagcagaaaaactttagctttctccttttgatgttgggggaaccaacacagttttactaaactcacatttactttggggtttaaagtgctaggcacattctttatctttctcttcttgaaaattaagaaatcaagatgcacattcatacaacaaggacatctgttcaacgatgttcatagcagcattatttgtaatagccggaatctgaagagagggaagagtaataagcaaaagggtcaagaccaggctggagaatcccagaaaggggagctcatggaccccagactgatatctgggaaatcagaatgggattgttccagacccccctgaatgctagtttggaggtctggttaatctatggggcctccggtagtagatcagtatttatccctagtatggactttgggaacccacgccacatagaggatagtctctcaatctagacacaggggagggtctaggccctgatccaaataatatgccagactttgaagatttcccaatggaaggcctcaacctccctgatgagcagaaagaggatgggatagggggttggtgaggtgcaggggaagaggggagggagagggaactgggattgacacataaaacaagcttgtttctgatttaaattaaaaaagggaaaaaagaaagaaattgttattcttttaataaaaatactgagaaataatcactttagtcacggatacttatattttgttatataatcaacatattttaaaatggtgaaagctcttaacttataatatcattacacatttttgactgttttactgaaatgggagaaaggattaagtttgccatcttggagaatgttcttactgtttctgcataagctaagttaaacttctgcaaccttaatcacacttacattggagcaaatggaaatgtgttagaagggtagtcaaatctcatatgctagggatcagctggtggcaacgagagtataaaattctgctattcacattgtaaattatgtttcattaatgtctctgtcatagctctaactacacaacagccaattctgcctcctttgacctttgcatctcttgcccagtgactccttgtctcaggtcgtcaagtattttactgactattagtacaaagacttattgagaggcaagaccaatgagactgttcagttttaggggttcatactggctgttttaaaatttacaatagcatggaactcatagcaaaggaaatcatggaattctaaagttagccaacaccttgttccacaatgttgactgtatattcataaacaaatctattctaatttaatgagaagtgatataatactttacatcttgatctacagtctttgtgaaaacatggaagtatttatatgattttaagcaactttgacaggtgccattatcagaacactgtcaatctgctaaaattgttgtgtattcataatttaaacgttagatgctgaatgatccctatcagtgtttcctaaaatggcatgtagaactatttgttcattgtgttttttgaaagacattgtttcttactgctttttgccactaggtggaagaagcaggttaacaaaatgatatttttggtgcttcagttaaccctgcccagaaacaaccagaaaattgtgtttaaaacaaaggtataacaagcagtcttttatttatttgttttattaattagttttttatatgaatactgaacctaagaacagtgttttttagagttacactttcttttatgatttttaagaattataaatttcaatggtaagcaaaaacaattgtcagttggaagagatataacaattaataattttggtaacataaatatcagaaagtagttcttagtaattgttcaaggaagtatgcccccatatgaacattaaaccacatttattcaattattcttttatgtcacaagtatgtgccaagcaaattgcacattacagattcaaaagagttactgtaaaccacaccagggacgacttggggatagctcctctttatgagatatttcattctaaaagaaatgtgagcaaaaggaaatacaaatacattaatacatttttaaaattcagaaatgggtaaacactagaaatagatacaatgtttggattacatgctggctagtgatgctggtttgaattgttatttttatctgataacaacacagatcacttcatgaagaaacgaattaaaatggatcttctaagcaagaggatcaaggaatagcactccagtgagataggcagaaggtgaaggcacaaatataagaaataacaattttaaaaaatattcaaagatgaaagggaaatacttttaaagtaatttaaatattttcatagagaagacacagtttttttcaataggtgatgcatacaggaaatgtaataagctaaaacacctagcagatgagaatagaaggtaccggggacagtaaaacttctacttggaagtggaagctcacttaggatgaactagaaaattttagcatacacttgatggataccagtgttctgtcaaggtgcaggctttctatgcaggtgggtctggaaattaatgggcagacttcatgaggaattattaaattcagacttgcaaagacagcttcttgggacatctattctctattactgcttttatgtatgtcctttgcaaggagacctaagtggcaactgtcatttaactaccatgaaccaatatttaaggccacacctcatacctaccacctaccttttttacctcatagtctattcatatgatcattctgtcccagccactgaaagtgatggacctgaactctgatgttatgagtggctataaaattatccagcttttaaatccaatcacggaatttgattttatggccaccaatggaactatagctacaggttaactaaagattgtgaagtaatatttcctttttataattctgaaatcactgccttgtaacttcagagatcaccttgttctactgtgggacaagctttatagcattataactttgtataactcagagaagatctagtaactttttgtttcctagttcagatttatattattcctctgatattgcatagaatttatcactgttttaattgctagaaatacatatatatgagactatataaatttgaaactatataattttaggcttaattttcctgttgtgtactactatacccataagtatgacgaagttaaaattattgtataaaaatactatgcattcaatcctatttaaattacatgtatgtacaatactacaaagaattactaggctacacccaaataatcatgtacacaatttccattaatataatttttattcccttgaattcttttaaagcaacttagtgttcaaggcctgtgagataactcagcaggtaaaccattgctgcacaaatctgaggacctgattttgttacctacaacccacagtggtaagagagaactgaatcacatagttgtcctctgaccttcacatgtgtaccttggcagacacatgcatacatagccccacacccacacctacagatctacccactcagcacccactcactcactcatacacataaaatttaaatgtaaaaagcaacatggttttaattagtgtagatgcctattttcatgaactcaaattaataataattctagttatttttgatatatctaaaaatggtgtagccatgcttggatctcattagatagggatagtaattctattgtgctgctctttcatgctttttatgatttctatactcttactttatttttaaaatttcacatgtgtgcaatatatgtatgttggtcatattaatcccttgcccattctttcaactcctccttccctggcatatcttcctccttcgccatttatgaaacataatttgattctctacaaggagaatgacactagttagactttcaggtttttctacctgcaattaaaacacttcaaaagccataattcatagcaatattatattgcaatataactttaaatgtgttcatagaaggataaaagttgaatgtgaaaatttacatgagttatgaatctttttaggcttctatatatatagtcaaggtaaggatgggctcttatttgaaaaaagactgagaaaaaattgtaaaactcctttacttgaagaagtgaaacagcaaggagtttcagtcccattgtcaagactgtgtatttactttatcctcttgacccaatgtaactgtgcagctttttgtaattcttacagatacaggtagtaaaaccaagaaataaaatcccctaattctggtaggacccagccccaactctaatgtgacttggttttttattattttaacttgaaaatcataggtgattttcctacagacatactagttttaaaaagaattatgtttggttttttgggagggggttcgagcacagagtttccctgtggatttggatgtttctaaaaggttgtacttctagtaaaatgtaggccttaaaagagcactgtggttctcctgtagaaagttagaacatctgttagttgtggaacagctctattactagtagggacactaagttcttcttagtaaaccttattttaaaactaacaactaaataaatacctcacaaaaatcacttcatcaggccaattctgtactgtgtactgctggcatcacagagggatttcactgaggtttcagcagttgagtgtttcataaagcatcaagccattttagaaaggggctgacagcacaatgacatcagtgatttaatacctgcatgtctaagggtgtgttgtgctgtgtgatagttttgtacagcaacttcacatgtagaaggattttataagatatgaagctctgttaagaatttttggtttttgagtcctagaatttaggaaaaacacattgttcacatgtatttattttattttgtatactttttgttgacatttgatgtccctaaactatatgaaaaacaactggaattttctacatttcaaattaatactactatgacagtttgaatttttaaagatgtgacagtttttctgaaatttgtaagttgccacagaaatgtctctgatcatgttaaagtattaaaaagaacataatctgtttataaagaaaggaaaaacaattcagccataaaatattaaaatataaaaaaaaatccaaggttttttctgaggaaatctagctcaatgacagacacaatttgagaatatttaggagcaaaagagcagtgctcctactgaatgaaatgagtttcaaacttttgtggataccactttctcttgttttattttatcttatttataacttttttcatttattttacataccaaccacagtttcccctccctcctctcctcatggtgtctgctgtccctcccttcccatttactctctccccattcactcctcctccatctccactgggaaaggacaggcctcccatgggtttggacaaagcatggcacatcaagttgaggcaagaacaagctcctcctcctcctcctcctcctcctcctcctcctcctcctcctcctcctcctcctcctcctcctcctcctcctcctcctcctcctcctcctcctcctcctcctcctcctccatggggaacaggttcacaaaaggcagctaagtaccaggggcaggtcttgatctcactgttaggagcctcatgaacagaccaagctacacaactgtcatacacatgaagagggcctagatcagtcccctggaggctgcctaactgttggtccagagtctgtgagctcccacaagctcaggtcagctgtctctgtgggatcccacatcatgaccccccccccttactggatagagtatttatgatagcaattagggtagtcaccactatgattacgggagatggccagttcaggcaccctctccactattgctaggaatcttagcttaggttatccttgattcctgggggcttccatggctccaggtttctccacaaccccaaatgatccctccatcaagatgtctctttcgttactctcccactctgtcctgcctccaacctgcttttgccacccagcctacccaatccatttccccactttcccatccctctacccccttttccctgaccccagtttacccaagatatctcttctatttccctttcccagggaaatccatgcatccctctttgggccctccttgttatctagcctctctggggctgtggattgtatattggttatcctatatgagtgcaaaattatacaaccactttggaaagcaatatggtggcttctcagaaaattggaaatcaatctacctcaagacccagctataccaatcttggacatatacccaaatggatacacaatcataccacaaggacatctgttcagttatgttcatagtagcattatttgtaatagccagaacctggaaacaacctagatgctcctcaacaaaagaatgaataagaaaaatgtgatacatttacacaatggagtaaattactcaattgtttaaaaaaaaatgacctttgcaggcaaatggatggaatcagaaaaaatcatgctgagtgtagtaacccagaccaggaaagacaaacatgatatgtactcactcatcaatttctcttgtttttatgatggaatcattttctaaagggctgcttaaacctgtatcattcagtgcttacagtaaattattcctggacctaaagtttgcttctcctccatcataatcactttggttaattttgtttacacaatgagaaatgaataattgagtcaacatcagtgtatctagcactgggagtgttatgttacagaaagagaataataagttacattgaattgacttcaattctattctttaagatccctttcttttacaacatttgataagaactacttgaaatgaagactatagttttggaaataatagcttatcaaagtaattagggaaaattgggatagaaaaatacattttaaataagacttcaaatttcttagggttttggtcttctttatatgtctcaaaatatttttcagtaacataaatctcagcagcaaatttcttgctaaattgcctcaagtgttgctcatggttccagcatacattctaatgtcaaccccctaaccagcatcccttctgcgagcatctctactctcgggactcttcattccccattgcctcttattctccagtcacaacccaatccctgtggctttcacatggctctgtgctttcgctcaagctatttcttcctattgtaatactctcatttctggttccctttctagatatcctgtgacatctttgttagcactcaccactctcctcattctaactatctgtgctacatgctgataatctattaaggacttttgtgaaggcactttcacactttttttctgcagtgctgtgttctccattaaactacaagccactggaaaggaaggaagacattttgtagttctagcatctactatagaaaatatatgggtatacaatgaagtcttccattattaactggttagtacttcctaagtatttgatgcatgccaaataagaacaatcttctaatgtatttttggaggaatacacagaagtcagtgactttcatggaaagcaaacaaagaaagtgtgttgaggactggggagatgactcagtaagttcttgctgtgcaagaaggacttgagtttgaatccccagaaccaagagaaaaaaaaaaacagaaatggaagtgtttattctataacttagtgctggagacacagatggatcttcagagctttctgggaaggttagccagtccatgaccttgggttcagggagaaaccttgttgcaaaagataagatggaaggggagacaaggtagcttagaggacaatgtacttgatgtgcaaacatgagcacccacagaaagttaggttcagtagtttatgcctgtgaccccaggactgagagaccataaacagaatagaaggggtccaagagctcactggcttaccagtctatcccaacggttcagtaggagaccttgtctcaaaaataaagtggagagccataaaggaaagtgcttgacatcaactctggtttgggctgctatgtactcgtgtacaccacacacactgtactcaagatagggtggaggggaaggagggagggagtgagggagggaaggagggagggagggaggaagggttgaaggaactgaataatgacctctggtctccacatgcatgtgcacacacgtgcacatgcagccagttgcacacatgcacactatatgctacaccgatgaaagaataaaaaggactgaagaggggatacctcagttagtaaagcactttccacggaagtgtggaaggtgtgtgtttgcatctctagaacctatataaagctgtcatggtgggtccctaattcccgtgcccttatggtgagatagtaggtggagctagaagatgactagaagctcatgggccaagtagattggcatatttgaagaacaacaagaaacctacatcaagaaagttggaagatgagaactggcacacatggtacacataacggaatacacagaaagcataacatacacacataacacacaaggagggacaggggctgggacttaaagtttattaatggatgaatacccagcatccccaggctccaggaaaatctttgaatggaccctggaaagatggcaagggctatagacatcattaaattcaacttctctgaaagtagacccctttgtctgttcctatgccaaattgacatccacattttaatacctgtgagaattccgtggcattaatatttctgagaaatcactgtgaaggaatgaaagtagaatatttgcatcaataatggataagttgccttgactttcaataacaagggctttaggatattacatgttatttaaaacattttataacaatattgaatataaattatcatttaatacagtgtcaggctttctttctttgattgtgaccttctgttaacatttattttctttggtttttttttaattaaatttctttaggtgctgcttatttttaaggggcagaaggaaggtataggcaggtggattccctgagttaaaggtaacctggtaaagaaaacactgttgctcgatttttgtacagtgattattcttttagataatattctgcgttcaagatagaactaggaacaaatttcaaaaccttgagcatctctctagaagagaaaaatatctcagctctaatacaatagcctcatctttattgaacattgaaaacacgtccatcaaaagaataagtattttaaatatctagtttataacctaacaccagtttgtgcaatttccaatgtagatcataaataaaagggggggaaaggcaacattatgcctctgaaatgtactaatccacagtaatgcctccaaaagaaaaagcaaaaataatgaaaaccttaaataaatgagaacagaaagtagtggggtgtgatggcaaatgcctttagtcatagcactacggaggcatagacaggtggatccctgagttcaaagtaacctggtaaagaaaacactggaagaaacaagttatgagactggggaggtaaatcagtaattatcaggactgctgcttttccagaggacccaagtttcattcccagtaccacgttaggcagctcataacctgttaactacagctatgggatatctgagatctgactacctatcctgtgatcaacttgtgcatgtgcatggcccctgcccccaccccacccctgcccccaaagctactgaatgtaaccatgttggattgagccagtcttagaaagacagatgttggatttttgttttgtttttgtttttcggtacagggtttctctgtattgctttggagcctctcctggaactcactctgtaaaccaggctggctttgaactaacagagatccgcctacctctgcctcccgagttcttggattaaaggtgagctccaccaatgccgggcgtgatgctggataatttatctcttgtgtgtttccaaatttatatagatacataaaaccatacaagtatgcatgtcatgaaagtagaagtaaaactgcctacaggaacaaaggagactaatggaagaggagaaaagcaggagggcatggaatgtaggaacatattcaaggtaattatgtattcataaaatggctttatgtaatatactactatgtacaatgaatacgcatgcagtgaaagttaaaagaaacataaggaatggtttttatttaaaatgacttaatttgttaggttctttaaaatctttatactttaaagattttaaaaaacctcttcaggaattatttcagatcacaggtatacaataatggaataaaatggcaatagttctttcctcatggggcttttactgaatgtgttcatagtacaggggttacggctgtattgaaaacaatctttctcctttctcttttgaagcagggtcttatagtcttgaacttttcagcctccaaatcctgggatcacagactcaatatcctactaaatcagtttagaacatgttagagagactatgcaattggcttatagctgttgagcatgtagcaaagtatcttaagcaactcgcttgcattatcttactgcatcgtctattaggaaggaagtgttattattctatttattctatagctgaggaaactgggaatagtatatgacaagtcagggatttgaacacagattctcactgagaagcccacattttttaaccacagcactgttttctttctatgcccagaatattgggatgtaagagaaaaggctcaattaatggttagtgaataaaatgatttctattcacattgcaaaaaatggctctgttttgggtagtagaaatgccacaaagatgggtgagctatagttctttaccttattttctttaattaaggttactaataaactggagagagccatttactaacttgcctgcaaaatgacaggatcctgggcataaatatgagcatgacaaaagtcaacagacagccagttataaattaggacagtaaaattacttcacgactataacaagaatcaatcaagaagtctaaactgttgttataaatgatgaatgaaaaggattttcaattttaattaaattaatcttgaagtcatgagacataattttaatttctgtattctgaatatcaatcttaatttctaaattcttaaacctttcttgttgtttttaaaggatgagggcatctgagatatttttattttataaaacttacagcattttttagattatttcctagtaatctattccttgattatcaatagtttacttctaaaagttgctttttacttgctgttgtcttcctttgcctgcttgtgtgtgattttctatttattaatttacttattatgtgcctcccaattttctctcccacttttcttttactcacttggcatagaatcacaaaagctagacactggagagatttcagggctctatttacattttttatcattttatttttttaaatttttttattttaattagaaagaagattaatttacatgtcaattgcaggtccatctccctcacctcctcccctgcccctatccaactaacaccctacttatcacataccctttctgctccccaggaagggtgaggccttccacagggggtcttcagagtctgtcatatactttgggatagggcctaggcccactcccctgtgtctaggctcagggagtatacctccatgtggaatgggctcccaaagtcctttcctatgctagggataagtactgatccactacaaggggccccatagatttctgaggtctcctcactgacaaccacgttcatggattctgcatcagtcccctgctagtatcccggctatcagtctaggaacccagagctctcccttgttcaggtcagctgtttctgtgggttcaccagcctggtatggacccctttgctcatcagtcctccttctctgcaactggatttcagttcagttcaagtcttagtagtgggtgtctgcttctacttccaccagctgctggatgaaggctataggatggcatgtaagttagtcatcagtctcattatcaggggaggtcatttaaggcagtctttcctctgttgcttagattgttagttagtgtcatctttgtagctctccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctccccaggaagggtgaggccttccacagggggtcttcagagtctgtcatatactttgggatagggcctaggcccactcccctgtgtctaggctcagggagtatacctccatgtggaatgggctcccaaagtcctttcctatgctagggataagtactgatccactacaaggggccccatagatttctgaggtctcctcactgacaaccacgttcatggattctgcatcagtcccctgctagtatcccggctatcagtctaggaacccagagctctcccttgttcaggtcagctgtttctgtgggttcaccagcctggtatggacccctttgctcatcagtcctccttctctgcaactggatttcagttcagttcaagtcttagtagtgggtgtctgcttctacttccaccagctgctggatgaaggctataggatggcatgtaagttagtcatcagtctcattatcaggggaggtcatttaaggcagtctttcctctgttgcttagattgttagttagtgtcatctttgtagctctccagacatttccctagtgccttatttctctttaaacctataatgtctccctctattatggtatcttttattcttactctcttctgttctttctccaactcaacctccctgtcccatcatgtcctcctcaaccatcttcttctccccttctcattctcctagttactctgccctccctccctactcccaatttgctcaggagatcttgtccctttccctttctccagggcaccacgtatgtctctcttagggtcccccttgtttactagcttctctggcagtgtggattgtaggctgctaatcctttactctatgtctaaaatccacatatgagtgagtacatacaatatttgtctttttgtgactgggttacctcgctcagattggtttcttctagttctatccatttgcctgcgaatttcaagtttccattgttttttgtttgttttttttttcccactgagtagtactccactgtgattcagttagaagctcctcctctgtctcactggagaagcacattctctggcatccatttggagctgtaagggtggaagtccaaattcacttacaaactcatgtatagagagcaacttcctatatatttgaaacttggtttatatacattctggattggctggttttgccttttatattatcagaacaattttaattttcatctattctccacagcagtgtcttcctagccagattttctcgtaatatcaaaatatcacaatatatagatactaaatattagaatactaaataaacacaaaaaatatagatactatctgttcacctgtttgagaaagtctatgttaagtcaagtgctgtattgaatgacagtattttgcaatttttttataaatgaaatctgaagagtaaatataaaagataaataaggtatacaaagtttgtaattttattttcatatttctaattatgaacattattgacttactgttaattcttatttttaaaacatcattgaaaacatgtttataattttttaatgttgtatgtataaatatgtggaggtcagaggacatactgtgatagctggttctgtcttccatgatcttttgataattatttggtaacagcttagtgtcagacattatgagagcttgtagttaatgtaatcattggttgaaatgcctagtcaatgggtaaaaggtggtaaactgattgtggaattgagagccactggtacattgctatctctattttgtgagtagaactcgatagcatagtattatcagatggtcagcattctcaacatgaacccaagcaactgattttgaaaatgaaattctcttacttgataattaaccttctctgttaacagaaaagctgaaaatttgggcaaagtttagtaacatttgccacacgttaacaattactgtgatggttcatatcagttgtcaactgaacaggacctggaatcatctggagacaaatctctggacatttctatgatggatattctagattagatgaattgagtgagaagacacagcctaaatgtgagcagtgacattccatgggctgggatcctggtctgaataaaaataagaaacagcccctagaatgaatttcccctctctctgcttcctgaaggtaggcacaatgtgaccagttgccttgagctcctgctccacacagtgcagtgttttcagtcatcaatatagagctctaagggtagaagattggattggttttttcctagttagagggctttttaatataaaaaattcttttttattttacataccaatcccagttccctctcccttcccccctcccacccatcccatgtacccatccactcctcagagtgggtaaggccttccttgaggagtcaacaaagtctggtatatcaaattgaggcaggaccaagcccctcccattgtatcaaggctgagcaaggtatcctactatatggagtgggctccaaaaaaaaaaaaaaaaaaccagttcatgtccctgagataggtcctcgtgctacttccagcctccacacccacagatcaagtcacacaactgtcacccatatttagagggtctagttcagtcccatgcaggttccccagctgacagtgcatagttcatgagctcccactagcttaggttagctgtctctgtggttttactcatcatggtcttgaccaccccccttgttcatatgatccctcctccccctcttcaaccaaactccaggagctcagcccagtgcttggctgtgggtcacttcatctgcttccatcagttcctgcatgtaggttctgtgatgacaattaggctagtgactaatctgataaagggggaagacccattctgttagcctcttcactattactaggagtcttagcaggagtaatccttgtggattcctgataatttgtctagtaccaggcttctccctaacttcataatggttccctctatcaagatgcctctttcattgctctccccctcttttcctccctaactgggtcttcttgatccctcatgttcccatccttcagccctcccttttacccccctccagtttacacaggagattttaactatttttgcttcctgggggcttccgtgtgtctccctcttatggttcccttttatacctagcttctctggggctgtggatcaaagcctggttatcctttgctttacaactattatctgcttatcagtgaatacataccatgtttgtcttttttgggtctggattacttcactgaagatgtttcttttctagtttcatccatttgcctgcaaatttcaagatgtcattgttttttttttaaaccactaaataatactccattgtgtaaatgtaccataatttttttttatccattctttggttgatgagcatctaggttgtttccatgtactggctattacaaataagcttctatggacattgttgagcaaatgccctgtggtatgattgtgcatcctttggatttatgccaaagagtgatattgctgggtcttgaggtagactgagtcacaattttctgagaagctgccacactgatttccaaagtagctgtgcaagtttgcattcccatcagcagtggtggagtgttccacttattacatatcctctccaccataagctgtcaccagtgtttttgaccttagccaatctgacaggtgtaagatggtatctcagaatcatttttatttgcatttccctgatgactatacggatgttgagcaattccttaaatgtctttcagccatttgagtttcttctgttaagaatttgctgtttcgatctgtacttcattttttaattggaatatttggcatttttgtgtctagtttcttgagttctttatgtattttggagatcagatcagacctctgtcagatgtggggttggtgaagatcttttaccattttgtaggctgctgttttgtcttattgactgtatcctttgctctacagcagcttcttagtttcaggaggttccatttattgattgttgctctcagagtctgtgctgctgctgttatatttaggaagtggtctcctgtgccaatgtgttcaagggtacttcacactttttcttctaagaggttcaatgtacctgattttatgttaaggtcttttatacacttggacttgacttgtgtgcagggggttagatgttgatctatcttcagtcttctacatgtcagcatccagtttatgccagcatcatttgttgaagaagctttctatttcctattgaataattttggcttctttgttgaaactcaggtgattatagatgtgtggattagtatcagggtcttcaatttaatcccattgatccatctctctgtttttatgccaataccaagatgttttattattgtaattctatagtagaactcgaagtcagggatagtgattcctctgtaacgtgagctttcttgcccagaaggtctggctgctccccttatcagccccaaataaacatgcagaagctatattagttataaagctgttgacttagggcttcttattggttatctctgtcttaattatcaacccataactagtaatccatgtatttccacgtggtcttatcttatcagagagagtctggacctgttactcctccgacagcctacatcatgcctgctcagcatctccacaaagaagagagctattccttttttgtccctgcttaaatcttgtttctgcccagctatgtcatttcctgcctttctgtacagatctccagacctctatggtttactagtggcagttcctgcccagctacatcacttcctgggatcacatgacaactcttctcagcctatacttcccagaatcctccttgtttcctagtcctacctctcatccaatttctgatgtcttcaatttcttttttcaaagacttaaagctcttgtcctacaaatctttcacttgttttgttagagttaccccaagatattttatgttgtttgtggctattgtaatgggtgatgtttctctgatttctttctcagcctgtttatcatttgtatataggagggctactgactttttttttagttaatcttgtaccctgccactttgccgaaggtgtttatcagctgtaggagttccctggtcgaatttttggggtcacttgtgtgaactatcatatcatctgcaaatagtgaaagtttgactggttcccttccaatttgtatcccctgatctccttttgttgtcctattgctctagcaactttgagtactatattgaatagatatgaagagagtggacagcctttcttattcctgattttagtggaattgctttgagtctctccatttagcttgatgttggctgttggcttgttgcatattgcctttgttatgtttaagtatgttccttgtatccctgatttctctaagacttgtatcatgaaggtatgttagattttgtggaaagctttttcagcatctagtgagatgatcatatgtttttttctttcagttcatttatatggtaaattacattgacagatttctgtattttgaaccatccctgtgatgaagcctgcttcgtcatgatgaatgttttcttttgatgtgttcttggatttagtttgccagtattttattgagtatttttgcatcagtattcatgagggagattggtctgtaattctctttcttagttgtgcctttgtgtggtttgggtgtcagggtaactgcagtcccataaaaagagtttggcaatgttccctgtgcttcttgtgtggaacaacttgaggagtattggtattgtattagctcttttttgaaattctacattgagttctacattgaaaccatctggccctgggttttttttttgtttgtttgtttgttttttggttttttttttttttttggttgtgagagtttttatgactgcttctatttccttgggagttataggtctatttaagttgtttatctgctcttgatttaattttgttatgtggtacttttccatttgggataagtaccacataccaaaattaaataaaaattggaaaatttaaaagaaaaattgtccatttattttaaattttctaattttgcgtagtacaggtttttgaagtatgacctaatgattctccggattttctcaatgtctgttgttatgccttccttttcatttctgattttgttaacatggatattctctttgtgcctttttgttagtttggttaagggggcaggggaggagaggagggagaaggagctggtattgacatgtggaataaggttgtttctgatttaaataaaaaagtctgcttaccaaagaaggaagcattattaaagcttaaatcacacatcaaatcgtacacactatagccttctaacgttccatgaggtgctgaaaagaaggcatattcttttgtgtttgggtggaatgttctacagatgtctgttacgtccatttgagccatagtatctgttagttctattatttctgttaagtttctgcctggtagacctgttcattggtatgagtggggtgttaaagtccctatatttgtaaaactacaaatttataaattatttctgaattagtaagcaattaataatgtctaacaataaaatgggacaattcaatacacttagtgaagattacgtgtgtttctttttctctcaattgaaaacaccttactatcctgcacccttcttgggatgcttaaaatgaagcataaagctatttgagcatatcattgtgattctaagcagttaatctgatattctggttagccaataagtgactgatacacaccaggtataccagagtaagggacaacttaagtcttggacagagcaagtggagtcagaattagaattcctcatgctattctcctggctactcagaatgtcacagaatttcaagcttctgggttgattacttctggaattttccatttgatatttttggatgatagataaccctgtgttatcatagataattgaaactacagaaggtgaaaatgcagatgatggaaggggactacaaacattatatgcatacacatttgtgtatacttgtgttatatatggaacagttaagtattttttcaaagtcatattttgaaatgatttgctcatttttgttgctatgatttattttaacatgtagaatgtgtatgttcctcagctgaaaattaggtaatcagatttttaaaattttattaaggtgttagaaatatttatttttcaaataattctaaatgcatatgatttcaaatattacttcacgggtttgtgattcctttgccacatatctcactattctttctttcttctacaggtaacagctttttttttttcttttgtttttttgagacaggttttctctgtgtagctttggaggatatactggcacttgctctggagaccaggccggccttgaactcacaaagatccaccggcctctgcctcctgagtgctgggattaaaagtgtgcgccaccaacgcttggctcaggtaacagctttttaagagttttagttattatggtttgactataaaatgtctgtcattagatcatgcgattgaaaatttggcccccatctgttcgtgctgttttgggaagctgtagaacatttaggacacaaagcctacctgaataatatataccatttgttataaacttggagggttatagattaggtctgcttcccctagtggcatcacaagcttctggaaccatggagttctgtgctgtgacagactgatataccctgaaccatgaaagcaaatacatcctttctttatgtaggtgcttttgccaggactgaagatcttcttgtattactaacaggcttccatgagatgctaaaagccactggtctgaagacaacaccttgtgcaaatagaccttaaacatttttatttcaatagtgtttcagtgagcttttgtcaggatatcaaagacaggcaactggactctgaggtatctagtaagcatttgtatgtgcagggttctagttaccattaaagtaagactcatcctacttttgtcacttggtctagagtggcaaaaatgaaatatgaattgttctgatacctgatgagttgctgcccacattctgctttttccagtgaagagattgacaggagaatctgtggaaatgcaggcagggccagtattgctgatatggatatcaagatggtcaggcctttggccctcttcttctctcacagagacagaatgagcattttatcagtatatgaaaatgaatgttaaaacctttacaacactcagtagtttcataacattaagtactcacaataaaccaccacataaatattgttggataagtttgatttgtctttgaaaggttgccttggaggtctgtggtgatatattgtttataatctaataaaaccattgaatatcagaatgcaaaacagccaatccaccagagagctcctaccactaccaaggctggaagggggatcctgtcctcactgtggctggagactaattgccagaatacgagactatgatcctattttatatacctctctagagctggcattaaaggcacaagctgagtttatcttttagattgatttgctctcatgtagccccaggtggccttgaactcacagagatccatctgcctctgtctccagagtcctagtattaatggtgtatgccacccctgcctggcctctatggctgactaatgtgcctggttttgaattctgatcttcagtggttttattagatcataaaatatatatcaccacaactccccctttttgtctaatacaaaaggttataattaatataagaaaaactatatacaacaagtataataacaatatataatatatgcaggcaataagtacatcgacaatgtctagtccatttacatttgacaaattcagagaaaatttgctattatctattctatcatggtgagtccaaagtcttgtacctaatttactttctactttaatttgcattatcacattatcttttaatgtctcttaaccttttacactttatacctctttagtgaatttcttttctgagtcttgtaaacaaggaaaacgtagctataactatctagtcttcaacttcttcagagacccaaaaatgaaataatattaaatgagtaagcagtaagtacaagcaagcgacagccaaaaatttgagaaatgacaaaaacaactggatgcctggacagacacccaagtttcctctgcaatgttggagcatccatttttggcctataggcctagcatctctgacagacttttctgtaaagtggaatttttgaaggactgccccagcttgtcttgtcaaagtttgctgtcattcttttttgtgtcccacctgtccaatttgaacagcatactatcagcagtagagacaatgacacttttttgcccagtggcttacttttgccacaaagcataaactccatgttgagtttctttgatgcccaacatcctctttgaagtagattggtgctaccagaagcagatatgtctcattgtcacaaaaagaacctatgttattaaaacatcttaaatgctatattttgtacatctctgaagtgtttgaagatgacctgtctttctaaaatatatctttatttgaccttgaaatcgtacctcatgtgactacagttcaattgtaataaattgctaactactaacctgtgtttccttattatcctatatagttggtaataactttcaaggactagaaatttgcattacattgttaaatggatctatataagttcaataccttgagtaaggttaaaaagtatctacagtatgttttaacaaaaataatctcaaatttgtataaatatataaagtttgcatacaacatacaaatgtccaatccaatgtaaaatatttaaaactagtagctgctttttaggagtagattcaataatctactttttaaaaaatcttatcatatctgtatcttcctttttttttctttcagagtagattcaataatctacccttttatcctatcatgtctttatccccttttttcttttcaaaacaagaactctgaatctaatcccctttgttaaactttcttcctgaccataaccaataacaacttgtaaccaacccccaaaacaaagacaaatatctataatcccaagaccacaaaccacctacctcacctcttgggaatgtgagtgttgtgttcttaaagttacttccagctgtctgggggtgatggcatctttagaggatcctgaaaagaaaatttgggttaattgtcaagttcatggagaggtagctgtatcattttcatccagtctctttgtaatggggaagtgcagtacgatttcaagtcgtagctagagtagtgtgttaggcttggtcatctcagctggctacctcgaaattgtcctgagcagtgtctgtgagcctgtatcatttcatcaagcctcctcaaaattgttctgagcagtttgtagtccaaagccaatctttagttggtgttgttcagcttaatgatactatcatagtcctggtgcaactgccatttcagggttcatcttttttgttgttgttgttttgttttttgagacagggtttctctgtgttaacagttctggctgtcctgaaactcatagcatgtctggagccttgagatgagagtggcagcccaatgagaggggctgttgggaaagcccacaatgcatggagagagagagagagagagagagagaaagagagagagagagagagagagagagagagagagagagagagagagatttcatacatgactgccctgatgaaattgcactaaactaaatttaatacctaaatcacacatatcacattaacagtcctacgtgaatcccctgctgagaatacatgaaacacactcaatataacttgcctaacatgcgcaaacacaaacttcactaaagtaactttgttatagttccaaagttcggatacaatgaaatagacaaaatgagctccatggttttgttcataagtgccctgatgaaattaaacaaaaccaaatttaaaacctaactcacacataacacagttactgtccaatgtgaatgcactgctgagaatagatgaaactcactcaatgtaagttacctaacattggcaaacacaatctttaccacacaaacgttgttgtagttccaaagttcggatacaacgaaatagacaaaactagctccatgctttcgtacatgactgcccagatgaaattacactaaactaactttaagttgcctaactcacacttaacatactcagccactgtcctacgtgaatcccttgctgagaatacatgaactcactcaatatacttacctaacaaaaattatctcggcaagatgatagagacctttaaagaggaaacaagaaaatccctcaaagaaacagaagaaaaagcaagaaaaaattacatgaaaggaaggaaaagacaaaccaaaaaattcaagaaataaacaaatctcttaaagaatctaaagaaacccaattaaaaacaaccaaataagtgaaggaagctcttgaaacagttcaaagaatagaagaaggtgaagaaacactgctcaaaggtacagaaaacatattcaacaaaatcatagaagaaaacttccccaacctacagaaagatacgcctatgaaagtacaagaagcttataggacaccaaacagaatggaacaaaaaaagaagtccccccgacacataataatcaaaactccaaatctacagaataaagagaaaatattaagagctgcaaaggaaaaaggcccaaaacaccaaatctatagaataaagagaaaatattaagagcagcaaaggaaaaatgccaagtaacatataaaagcagacatttcagaatcacacctgacttctcaatggaaactctggaagccagaaggtcttggatagataccctacaagcactaagggagcatggaaatggacaatgttctggatacatatcacttaccaaaattaaaccaagatcagataagcaatttaaatcgacctataacccctaatgaaatagaagcagtcatcaaaagcctcccaatcaaaaaaagcccagggccagatggcttcactgcagaattctaccagaaattcaaacaagagctaattccagtactcctcaaactgttctgcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaatccatcaatgtaatccaccatataaacaaactgaaaaagaaaaaccacatgatcatctcactagatgctcaaaaagcctttgacaaaatccaacatcccttcatgataaagatcttggagagaaaaggaatagcaggaacatatctaaacatgataaatgcaatatacaccaaaccagtagccaacatcaaaataaatggagagaaactcaaagcatttcatctaaaatcaggaacaagacaaggctgtccagtctctccatatctcttcaatattgtatttgaagttctagctagagcaataagacaagaaaaggggatcaaaaggataccaatttgaaaggaagaagtcaaactttcactgtttgcagacgacaagatagtctacattagtgaccccaaaactctaccagggaactcctacagctgataaatacgttcaacaaggtagatggatacaaaattaactcaaaaaaatcagtagccctactatatacagatgataaatccaatgagaaagaaatcagggaaacatcacctttcacaatatccacaagcaacataaaatatcttggggtaacactaaccaaaaaagtaaaagatctgtacaataagaactttgagactttaaaaaaagaaattaaagaagataccagaaaatagaaagatgttttcagacaggatctttctttcttttttcttttatttatttatttttccagttttttgagacagggtttctctgtggctttggaagctgtcctggaactagctcttgtagaccaagctggactccaactcacagagatccacctgcctctgcctccaagtgctgggactaaaggtgtgcgctaccaacacccggccgagacagggtctttctatgtagtattgcctgtttcagaacttatactgaatagaccagactggcctcacagtcacatgaacagcctgcctctgcttcctgggtatgctggtgtgaactgtgcatacagtagactaatggaatcaaattgaaaaccctgatattaacccacgcacctacgaacaccttatttttgaccaaggtgataaatctatgcaatggaaaaaaagataacatcttcaacaaatggtgctggcacaattggattcggacatgcagaagattgcagatagatcaatacctgtcaccatgcaaaaaaacttaagtgcaaatggatcaaagatctcaccataaatccagccacactgaatcttctagaagagaaagtgggaattacccttgaacaaattggcacaggagactgcttcctgaacattacgcctagcacagacattgaggtctgcaattaataaatgggacctcctgaaactgagaagcttctgcatggaaaaggacacagtgagtaagacagaatgggaaaagatcttcacccaacccacatcatctgacagagggctgatttccaaaatatataaggagctcaagaagctagcccaagaagctagccaccaaaacaccatacaatgaaattaaaatgtggggtgcagaactaaacagagatttttcaacagaggaatctgaaatggctgaaagacacttaagaaagtgctcaaaatccttggtcatcagataaatgcaactcaaaacaactctgagataccacctcacacctgtcagaatggctaaaatcaaaaataccaatgacaatctatgctggagaggatgtggagaaaaaggaacactcctccattgctggtgggagtgcgaacttgtaagatcactctggaaatcagtatggtggtttctcagaaaaatgggaatcagtctacctcaagatccagccattcctctcttgggtatatgctcaaatagtgcatgttcatacaacaaagacatatgttcaaccatgctcataaaagcattgtttgaaatagcctgaacctggaagcaacctagatgcccctcaactgaagaatggatagagaaaatgtggcacatttatacaacggagtagtactcagcagaaaaaagcaatggaatcttgaaattcgcaggcaaatgaatggaacttgaagaaaccaccctgagtgaggtaacccagtcacaaaaagacaaacatggtatgtactcactcatatatgaattttagacatagaacaannnnnnnnnnnnnnnnnnnnnnnnnnnnccagcctataatcctcttcaccaaagaaactaggaaagatgaaggactctaagggataaatggaccccaggaatgggaactggcatgaactcctgagctaattgggaacatgaggggaggggggagggagctaccacaataagagcaggggaagaggagtagaggagaggaaatggaggagcagaaatattgagttggggcaagaatagaggagagagagctggatgagggataccatttcagagggagccactataggtctgagaagagatctggaactatggagatccccagagacctacaaggatgacacgatctgacaatccaggcaatggtggagaggataacctaaacgcccttcccctaaaatgagattgatgactactctttatgccatcctagagctctcatccagtggctgatggaagcagagtcatacatccacagatatacactgagctggaatctggaattaagttgaatagagggaggaatgaagagcgaatgggtctgtaccaggttggagaaacccacagaaacagttggcctgaacaagggagagcacatcgaccccagatgctgtctgggaggccagtacaagactgatccagactcctgaacatggatgtcaacaaggaggcctctacactccagggagcctctggtggtggattagtatttttccctggtgtaagaagggactttgagagcccatcccacatgaagggatacactctggccctggacacatggggaagggcccaggcccagcacaggaagatttggtggactttgcagagcccctgttgagggccctaccctgcctggggagttgtgggtgtatggggtggggtgtaggttgggggtgggagaggagggattggggtgaggggagggagtgggaaaagggacttacatgtaaaacaagcttgttccctaacttgaaccaatacaaaaatttaaaaactgataaaatgaattttaactttgcttatttttaatcaattcatttttagtagctaactaaggctaatgatttccagagaagacatcatacacatgctgtggtgatgttttcagttttcttttaaacataattgcaatctcatttgttatagtgcttgagaaaatacaaatgcaatcagtgtttcagttatgaaaagtgatgaaaggaatgtagtaatcaatatatgcattgagagctacttatatactgcttgtttagtatcattaagtgtatacatgtgtaagtatatgtttctatgtgtatattaaaataaaaagaaatattaacttacaccaagctatctgctattatatgtacatatgcttattaatatatatgctgaccttattataatcagtgtatagattaatatatatgtacatagataatggtatagtctgactttaatatagctagtctatatattaatactttggagtcagaatacattaaaattgataaatagtatatgcatgaaagtcaactcaagaatatgtgactaatgaaaattaatgagtattttcaaaatgtggtgatcttatgcacatttatcattgtctatcaacaaaggtaaattcagagtaattatggcagaaaaataacaggggcatggtagagagatattaaaacaatgcctgggtcttttgggaaatgggatggtgattgataaaaatgtgaggtgatgatggaagaaggaaaaaataagtctgaattttatctttttgaattagaactggcattgaaaaattgatgcctgctctcactaatgagattttgttttgtatagcatttaaataatggaaatatactggctaacaatagatatactttaaaagtacatctataataatcacaatagattttccacaacaattaagatgaacattggactcaccatcaaatacaagctctattggttactttctatgtggtatttgattaagatttaactgtcccatactcggtgtcctcaacagaattagagaaaaagaaccactcaattcaaaggttttcaaagagcatgaaatgatataatgaatgtcaggcacttagtataatctttaatacatcaaataacccttcaaatggtagctaatattaaatattgatgaaaacacttataagggacaagaaacaacatttcaaatcccttgtcgtatgttttaaaaatgatgatgaaaatatagtgaggaaaatgcataacatttaggggatactgtcacaatacagataacatggagggttggaaaagcccaatggaaaagtgtaaaacttccagacgggaaataaggagatcataaaagaagatgtggaattaaagcatcacagataatcttaggaggaaaattatttaaatggagaaaaaatcacttaaaatacatttttttgatcagtaatgaagcctgagttgatgggaagtagacacggagaacctacttggctgtagaatgcccacatgctcttaaggttttctgagaacaaaacaaagataaaataagaatccaccagaattatggaggtttttacatacagaggtgtaaactccataaagggcttgtctctatattttttcttttcttatatgtggaaaacaaaatgtatgggaactagtacatatggcaattggtcacaagattctgcatgacaaacaaagccagacagatctagtattgcactggaagaagcatggtactaggtaatggcaagactagagaatccccacaagcggggccagacgaaggttgcatatagtaatgggaccagatcctagctggaatgttcctgcttattctcaatctatagtaatatcaaagacactagacaactccctgatgctgatggcaccaggatcatttgtaaagctccacacacactgtaataatgcttttgtctatttgtagtaccctgggaaactatgggggaaagcaacaggattgctcaacgaaggtgtggtcattgtaactccagatggttatgctcaaattaaactggatccccacacccagttatgagagaaataattttaagtggaaaatcatggattactaagatagtttatacacatatgtgatggccatttctttcttaatattttaaaggatttaatttcgtacttgatttcattctttacttttggttaaattaaatataacattaaaaatttttgttcatcgtatcttaactatgcctgttttattcaacttttatttctagtcatagttttcctaaatctatctctttagagccaagatatctagaaattcaacttcacatcctcagggatatttactagatgcatgtgtctgggtctcctatcagcctctaaaacttagtatttctgaagtaaatcaatttcaattttggtggtaacttcttggttcctagaagtgcagtgaaattttttaaatcagacaaacatgaaacctctgctatcattgagtctacaatctcttttgcctgtcatattcaaccatttgccaagctataccactttttggagttctactatgaagcagttagtaaaatagagtgaatgtccagtcttgtgaaatgctacagagtgaatggaattcctccagtagtgattactggatccatcagaactctagacattctgttgtagtagctagtaacccaagagaatgtatgtgacaagaataaaacagcagcattgttaaggtagtgctgtgtagtttggacagactttctataagcccctgtgcttatagatttgattcccttattgctgaattattggggtactgtggaagttttaggagatgagtccccaaagcagaggttctcaacctcctaacactgtgaccttttcataaagttcctcatgttgtggtgacccccaaccataattttgcaactcttatgaattttaatgtaaatatctgatatgcaggatacctgatatacaactctatgaaaaggttgcttgattcccacaggggttgtggcccacagattgagaaacactgccctagaggaaggaagctagagtcttggggaggatgattttagaatttagaatctttgctcctactctgtctctgcctacagccatcaagaaatgaatagctttgttcccccactcactcactgccatgctattcccacttgctattgctcaagtcctagaacaccagacaactgcctgaaggctgaaacagctgaaacaatgaattagaataaaccttctcttcttggttagttggttatcttaggtattttagtagcgtgatagaaagtggaccacacaagcgggaattgggagaagatgacgagaggaatggtccatgggcccagtcagaagaggcattcacatccttagcctcttgaaatcagcaatgtttatgattctaatttcagggtaagttatccattgcacagctttgttagcatcacatggataacagtatctctgtaaatgtcactgaagcactgaacagactgtagacgctaatcacataagaatgggacaagagaaaaacaagttgcttccccacactctgttttaatacatttaagaaatagtatagaaaggaaggatttgaagagcaaactaaatcttgtttgtggcacaaaataatgagcagtgttgtattttgttacctccttgctattatgtaagtgcaggatacatttttttaggtgttccttaagctgtgcttctggcatttcaaggtttagttatgatcatttgttttaggttttgcactcccttctgcccctcaataaattgataacagtatagtaagaccaatttatacaataccttttttaaaaaagaaagaatagatttttgcatcttgccttactgacaagtttgcaaattgccaatctttgctcctttctctccctcccaattcttcatggtggtaattaaggactgtaaatttcactttatcatttgtgtttagaatactagcataaatcatagtaatagcaccgtttatttcagtaatgccagcttgcctgcaaatcacttgtaaattggttccatagatgtacccccatcaaattaatcaaaaaaccacctgcatatatttactgagcttatttcaaaggcttatagcagtgaggaagaaaggcaacgctgaccttttcatttttatttatttataaattctgaatagctcatgcctatgttttcacttagaaactgaggacatccagctgaatgttttacatagttgttattctttaacacacagctgagacttgtgtttcaaataatatacctgcctgatggtcctactgtgctccacatacagtaatcataatttttgactaaccataacactatatatacttgagaactgtggtaagcaatgcttttgtatttttaatagtcccccccccccgccaccaaatgagtatagtatgttgtgagtcaggctatatcacttacattttcctcttgtatcaaggaaaatgattttgtttttttaaatttacagtatttatttatttgtacatgtgcacatgtgtacatgtgcacatgtgtgtcattgagtgtagaaggcaactctccttccatcatgttgattctgggggttcacactcaacttatcaggtttggtggcaggcacccttgcctactgagccatcttgttgccctgaggtaagtgattttgctgtggtgatgataatcttttcttttgttctttactatgctatctggaataataatgaagaaagttccaattccagttcatgagaggctggcccaggacaatctttaagtaatagattaagccagtttgaatgtgctatactcctttggaaatctcctgacaaaacatactcatgtgtagcttacctctaattagcctttaaaaatttcactttaaaaagcaaaataaataaataaataaagcaaaaagcatcacattgaagttggacaaggaaaaccaacagaagggaaaaccaacagaagggaaatagcccaagagaaggcacttaaaagagacccatttgttcacatactcaggagtttcattaaaaaaaaaaaaacaacaaaaaaaccacttaactgaaagccatgatacatatgcagaggaccaggcacagacccactggtgtaggtcctgtgcctgctgcttcactctctgtgagttcatgatccttgctcaattgatttagagggccttgttctcctggtgtcaccatcccctctgtcttttacattttttgtacctcctcttccacagggttccctgagctattccatttagaactgtgttcaaagtctctccctctcttcccccccgtctccttccctccttccctccccgctctctctagctctctctctgcataatgttttgttgtgggtctacttatttgttctgatctgcatcagagaatgcttctctgatgatggacaaaatcaggcactgatctatgagtacagcagaatgtcattaggagtcatttactgttactttcttttggcccatggtatttgtttttccactaagtctctagtctttctggtctcaggatcctggtcactcaaacagtattgggtacgtattccatctcgtggagtgggccttaagccaaatcagacattggattggtttctcccagaagctttgtgccacaattaccttagtatatcttgcagatagggcaccattgtagatcaagtgttttgtgcctatgttgtcatttacatttctcttttggtagcctgaagagtaccttcccctaccaaagacactagaaggttctatgtaggcaccagctcaccctcttcacgttcaatgagttgtgtgggtgttgttctcagcaatagggtcttgctgtccatttgcagagagcaacttatcttgtgtaactcagtcctggtactggatgatttgtttggtgacaagaaatggctagttgggacactgttgccttcattatttgtagacttcttaatgattgccttcatatattttaaagaagttttcatacccggctctaaagctcctcaattctagagttgtctctcccacatgccttccccacctccctacccccttcaccacctgatacttcttttccttctttcccatagctcccagcccacccataaaaactattctatttccccctcctggggagatctatgttcccccacccagtatctccccttacatacctgacctttctgggactacagattgtagcttggttagcatgtatttaatggctaatatccacatattagtcttaactcaagagaaggaagggaatttaaattccatgacttagtcttctctggaatcaaacattattaggaaaagataaatataatttaaactttatatttggaatttcaaagccagccagtgtgaattttagggtgcagagataaaaatataattaatatatatataaacctatatctttatatagatcttcatttctgtttctttgcccttgaaaaatatcatctgaatatgcatttgatatttcaccgtgttttcttctttgtagtctctgaatttagcatacaaagtcagaaataagtatagaaggattaatattcgtaaacagcctgcccttaatgtcttattatgaagatataccaagtttcttctagatacttagtagttgtatctatatatttttgttataaaatctcctaaatataatagatgatgttgaaggtgtcacacttaggaatttggtgtaggccaaaccagatctgctcaatgcttgtctcctgttcatacagttatttacatggaatcaaaaataacttacttggaagggtttttattgccactgtttctttgtttcttttgtttgtttttgagacagggtctttccatatagctctggttgtcctactactaactatgcagaccaggttggcctcaaactcacaaagatctgcttacctctgcctcccaactgctgggattaaaagcatgcaccaatatgcctggctaaggttgtttttattccaattagaaaaaaaaagagagacaagttcaatggattgccttgaatattgctgttattcaaataaatgagtcaaaatattttaattttggaaagcagaatcagagaattctgaaaactaatactgtttattagttatttcagtagctattatataatttattcataaggatatattcaataattattttaaatgttttaaattgaaatagttacataacttccccctttaatttccttacgtcagcccctactagataaacctctctacaaacacttccccactatcaatttgataacatctttttctttattatttttacatatattatatatacttaaaatttttctttgaccatcgaatctatttctgttatcgtatcttcaatgcctgaaattttctcttctatgccttgtattctgttgtttatgcttgcgtttgtggtttcctgattgcccagattttccagttccagaattcccttggtttgtgttttctttattgccgctatttcagatttcatgtcttgaattatttccttcagttgtttaattgctttttcttggtttgctttaaggtatttgttgatatcttctaattttttgtttgtcttttcctccatttctttaaagaaaattttcatttcttctttaagggcctcaatcatcctcataaagttattttttaggatgtttttcttctactttatctgtgttgagatgttcaggtcttgctgttgtagcatcactagtttctagtggtgccatattgctctttatattgtggagtgtgttcttacctcgtctatgcatctcttcctctaattggtgtaggtgaagcttgtgcttcagggggtctccctttctccaattggtatagttgggggctgcgtctccatgttcggttccttcaggcacaagtagagcagagcttctggtgaacaatcctcctggtggaagcgggcacaatgctcaggtggtcactccttgaggtgcaggtggggctacagctccagtggttgctcctcccactgtaggtgtaggtgtggctgagggtccagtggtcgatgcagtagcaggacatctccaaccgagaaatggcagtggatgctggctgggacacaggtnnnnnnnnnntcccagaggaactttttgtgatagtttctggaagctactgatggaaaccgctgctgtcatttcactagatggtcactccttgctcctaggcctgaggctgggacctccttctgacactgttcccaggtctggggctcatggctcccttgatgctgctccagacctggagctctggccttcctctgacattgcttccgggcttggatttggttctctctcacacatgtgcctgcatgtgtgtgtttacacaatcataaataaatacaagccgggcgttggtggtgcatgcctttaatcccagcactcgggaggcagaggcaggcagatcgctgtgacagcctccnnnnnnnnnnnnnnnnnnnnnnnnnnnnnnnnnnnnnnnnnnnnnnnnnnnnnnnnnnnnnnnnnaaccaaaaaaaaaaaaaaaaagaagaaaaatgaataaatacaacctgagtctatttttgttgtttgtgtgtatatgatttcaaagcctaccactctgcattggacaggctcatcccagagagaggctaattttccttttattagcagtcattagtgttctagcagatctagaggtgggatccctcaaaatttaccctttgacattaagggttagttgcctaaactacactgttcatccgtttgaaaaaaaggtttcccatgcctgttattggggtttgtgttagtctgtggttcctgtgagcactgtcagctcaagtgtgtgtgtgtgtgtgtgtgtgtgtgtgtgtgtgtgtgtgtgtgtgtgtgtatgttttatgtataattttaggtaaaaataaaataatatgattctttgagactttatcaaacaatcttggtattgtctcttgtccctccctctccttctgtactaacctcctcctatcctccccaattgaaaacccctcccattttttctgtttcccacttcatgttacctatatcctgctattctcttagcccatccatagtccactcctactttcctggtttctgtactaactccatgttgttgttggcttttgattgagattgtattgagtctaaattgctgcaattcacagtattaattctactgatccatgaacatgagatgtcttttcacttcctagcatatttctcaatctctctcttcagacatctgagatttcattgtagatatctttgctccccttaggtttattccaagatattttattgtctttgatgatgtagcaaataggagtctgtacatgcttctttctcagtatgtttgctattggtagtatgtttttgcttggtatatagaaagggtactcatttttatatttttggttgtgagcctagcctttaacggcagagccatccagcctggctactcatttttaaaggttgatttttaaccctgttacttggctgaacttgttattgtttctagttttctggtgggatttttaggatctcttatgtacaaccatatcatctgcaaatagtgataatttgacttttcctgtttctatccctttaatttcttctcttgccttcttactccagctagtgtttgcagcaaaatattgaaaaggagtagagatgatgggcagccctttcttttttctgattttaatgggattgctttgagtttttctccatttaagataatattggctgtgggtttgtcatatgtagcttttattatgttgaagtatgttacctcaggtattactttctctaggacttttatcatgaaagcatgttggattttgttacacagacacacacacagacacacacagacacacagacacacagacacacacacacacacacacacacacacacacacacacacaccctgtttctgtgggtttcaccagcctggtttggatcccccttgttcatcagtcctccttctctgcaactgggttccagttcagttcaaggtttagcattccaggataaagccaccttgatcatgttggatgattttcttgttatgttcttatattcagtttgataatattttattggagatttttgcatctacgttcatcaggaatatcaatttatagtttagttttttgtgtgttttatctttacatggtttgggtatctgagtactggttccatagagtaagtttagatcatggaaaattttcctttctccttcaactatgacagataatttccctgggcacggtagtctagcttgggagtcatagtcttttaaagtttccattgagaaatcaggtgttattctgatgaattttccttatatgtgtcttgtgtttgttctcttgcagctttcaatatatttatttgttctctgtgtttagttttttgacgatgaaaagccatagggtgtttgtcttttggtcttgtctaattggggttctgtatgcttcttgtatttgtatggctatgtctttccttagtttagggaagttttcttctatgatcttgctaaagatttgatctatgacattgatttgggattcttctccattttttatttccacaattaaagacttgatcttttggtggtgttctacatttcctgtgctttaagtttttttttttcttttctgtgctttgtgtagattctcttctttatgtttgaattctgatattctacattttgcttgacttattctacttgttagactgtcctttgttttctagttgtgttattggttttttttgagttccgtctttatttcagcttgagcccgcttcaatttctatcacttttcaattcagttttcaaatcttgaattatcattgagttgggggaagaacagaagagagcaagataagagataccataatagagggaaacattataggtttaaagagaaataaggcactagggaaatgtctggagagctacaaagatgacaccaactaacaatctaagcaacagaggagaggctgccttaaatgccctcccctgatgatgagactgatgactaacttatatgccatcctatagccttcattcagcagctggtggaagtagaaacagacacccactgctaaaacttgaactgaactgaaatctagttgcggagaatgaggactgatgagcaaaggggtccataccaggctggtgaacccacagaaacagctgacctgaacaagggagagctcctggtccccagactgatagctgggaaaccagcatgggactgatccagaccccctgtatgtgtgtgtcagtgagaagacctcgggaatctatgagaccccttgtagtggatcagtacttatccttagcataggaatggactttgggagcccattccacatagagggacactccttgagcctagacacaagggggtgggcctaggctctatcccaaagtatatgacagactctgaagacccccctgtggaaggcctcacactccctggggagcagaaagggtatgggatacgtagggtattagttgcaggggcagaggaggaggggaggaatagggaactggaattgatatgtaaaataatttttctaattcaaaaaacccaaatcctgaattatcttcattattttgcatatttgtattttcttgaacatcactcaagtgcttattgttatcatattggtgtttaataaatatatatttatgtcttctttaaattgtttgacaaagcttatgattattctcttaaattctgtttcctggggtttagagaatacttcttaggactagttgttttgatgggagacatgctgttttggccattcatgtttcttttatttttgcatgtggacttctttcttttgttgtattaacttgggcatgtggactctttcttttgtatctgatgtgatagtctggccttacttagattgggccagttctaggcctggtaaagcttgtgtgtgggctgtttaatttgaccagggaaagatggctctgaaaccatggttttttttttagcttgaacagacaaaggaggttcatggccaaatgactttcactaggcttgtgtttgcagttggccgttggttggggtaagggcacagacagaaaactgacttacccaagataggtggctcacacactaagaggatgaatagattgtcatctgtaattaggcttgtatcattaattcttgtggagaaaagatctggacatcaatggattaaagtggagactataaagtagagtacttgagggttgacaattttttaattaattattataagtgagaatgaaactagtattaaaaatacctgaaaggatgctcaaacagtaaatatatattgatttgtatttagagatacatacttaaaaattaagtttttgtaaatatataaatcaaagcatgttttcactacttgtatagtaatcaattttactctgataatgtaggagagaataaattatatttattttagccacaagaatatttttcagtgtttttggttccattagacttcaaaaaattttagtgtaacttcttaaataaagattaaagcttacttttacaattagaacttaatgttgaaagccagcacatttcatttatcaacaagcttgtgatttactgatggctaagttctcagaaacgctggaataaatgatctttctttctactcttctcacctctgctctcctctaaaataaatcatttccaaactgtcaacaaggatgagaaatttctagctaaagacttttttccctcctctaaggccttgggaaaaggagcttagagtgaaaagtgtcataactacaatatagtaagtgcatcctagcaagaataaataaaattgcaaagcctgacagtgaagaatacggagaggaattcaagtgactaaacctcaaataaaggattatccttgtttgtgagaaatctattccaggaagaaatcgatgcagcaggctctgcatacagaagcagctgtgcacacttgggtactgcaggaaagctgcagctgagaccaatagtcctacagggcagttgtcagccaacaggtgaccagtaacagtaatacttaccttggtctctttctgtgcagttatcaggcaatggattcactatttataaagcaggtagatcaatggtactcattcttcattaaaagaaatttggtactatatttttatagctctattaacttttataatctgaatttctacttggcgaagagaaataaagaaaactgagtgttatgaataaattgttaagtggtgctaattacataaaaataccatgagcagtagtggaagtaacaaataaagtgaaatttatcatccttgtccactttagagtcagagctaagagattttctgaagtcttaaaatgattgattggatgtcaccaactgtggaatctgtagaacattcaaacctggagcagcatgttaatatgtgaagaaggtatgtgcacttatcaagtaaattgcttctgttaggtcatatgttgctagattaaaaaagtgtgctcactaataaaatcaaagtttttgaaaaaagtttatgaaatgcattcatttattcatttctcaagcatttattaagtacctcaaatgtacctgtataaatggcagaggatagaaactcaaaggtctttgctcttgttaaacggttcctctaattaaaaatgttattgttttcaaaatgttttattaatttatttaatatttaaccatttttcttaataataagatttattctattccctgcatatgggtatgggcatgtgagtgcagttaactccagtgtccagaagagggctccatatctgcttgagttggagttaacagacaatggtgagccacccaacatgggtacttggaacctaacttggatcctttgcatgttgcatgagttctagttggtctaatcataaaaacctacagtcagatatagggataaatgctgaaagatcagagagacaaaggagcaagccacagccacacctcacctcaccaacttcttagctgaaaagagactgagttcctctttatcccccaccttatattcctcactccacccagccataccactccctgtctgtctgtacagacctccagacctctatggttaactagtggctagctgcaccttctgatctttaggtaagttttatttgttagagtacaaacaagatattactacatctccctttttttgtctaaaataaaaagggttataactgatataagaagaactatatataataactatatttgatatatgcaggcaaaaactatatcaacgatgtctagtccattaacaattggcaagttcagagaaaatactctattatgtatcctattttggtgaatccaaaaagctgtgcctaattcactttctagtctaacttgctttaccaaactgtatttttatgtctctcaatattatatactttgaatttctttagtgaatttcttttctgaatctgtaacaaggaaaactgtaactatagagttttcaactccatcagagacccaagaaggacaatatttcttaggtaaataagaagtgcaagcaagtgacttctaaataatatgagaaatgacaggagcagctggctgactggacagtcacccaaggttcttctgcaatgttggggcatccatcttcggggaacaggcctagcatatctgacagacttttctgttaagcagcatattctgaagggctgtcctactttgtcttggcaaagttcagtagtccttttgtgtcttgtttgtctgatactgtcagcagtcaaggcaagagcactttgttgccctgtggcaacttttgccacaaagaaagtaaagtccatattgatttcatcaattcccatcattttctctgaagcagatcggtgctgcgaggaacagacatgtctcattgtcataaaaaggtagaacctatgttattgaaatatcttaaataccatattctgtagatttctgaagtgtttgatgataatctgtctatatgaactatatctctatttgactttgataacatacccaatatgactacaagtttgattgtaataagtgactaattactaacctgcatttcattattatcctaaatagtttgtaataataactttcaagggacaaaaatttgcattgcattgttaaataagttgcataggtataataccttgaacaaaattagaaatgtatgtacagtatgctctaataaaagtaatcttaatatggatgcaaaaatactggcaaacagaatccaagagaacatcagaataatcatccaccatgatcaaataggcattatcccacagatgcagagatggtttaacatatgaaaatatgtcaacatatgaaaaaactggaaaaaaaaccccacatgatcaactcagtagatgctgaaaacccctttcacaaaatccaacaccccttaatgataaaggtcctggagagatcagggataaaaggaacatacttaaacataataaaggcaatatacaacaagccaacagccaacatcaaactaaacagagaaaaatgcaatgtgaattctctataatcaggaacaagacaaggctgtccactctctccatagccattcaatattgtacttgaagttctagatggagcaataagacaacaaaaggagatcaaggggatacaaattggaaaggaagaagtcaaatttttactatttgcaaatgatatgataatttacataattgagcccaaaaactctaccaggaaacttctactgctgataaacaccttcagtaaagtggcaggatactgcttcctgaatgtaataccagtagcacagacattgagaccaacaattaagaaatgggacctcctgaaactgagaagcttctgtaaggtaaaggacacagtcagcaagacaaaacaacagaacacagaatgggaaaagatcttcattaaccccacatctgacagagggctgatttccaaaatatacaaggaactcaagaagctagccaccaaaacaggaaacaatgaaattaaaatgtgggatgcagaactaaataaagaattctcaacagaggaatctaaaatggctgaaagacacttaagaaagtgctcaccatctttagccatcagggaaatgcaactcaagataactctgagataccatcttacactggccagagtggctaaaatcaaaaacacaaatggcagtttatgctggagaggatgtggagaaagaggaacactcctccattgctggtgggagtgcaaacttgtacaaccactttggaaatcagtatagaagtttcttaggaaaatggcaatcagtctacctcaagatccagcaattcctctcttgggcatatacccaaagaatgcacattcatacaacaaggacatgtgttcaactatgttcatagcaagtttgtttgtaaaaaccagaacctggaagcaacctagatgcccctcaactgaagaatgggtagagaaaaatgtggtacatttgcacaatggagtactactcagcagaaaaaaacaatggaatcttgaaattcgcaggcaagtggatggaactagaagaaaccatcctgaatgaggtaacccagacacagaaagacaaacatggtatgtgcacataagtagatattagacatagagtaaaggctaactatattacaatccataaccccggagaggctaggaagcaaggaggaccctaagagatacatacatataccctctgagaaggggaaagagacaagatctcctgagtaaatttggagcatgcggagagggggagatatatagaagagagaaaataagggaaaggggagggcagaggtttacatgaggggccaggaaggttgaggtgggggaaggacagagaaggagagcaaggaaagaggtaccttgataaagggagccattatggcattaacgagaaacctgacactagggaaattcccagaaatccacaaggatgaccccaactaagaatctaagtaatagcagagaggctaccttaaatgtccttcccctataatgagattgatgactaccttaaatgccatcctagagccttcatccagttgcttattgaagcagaagcagaaaatcacagctaagcactgagctgaactcctggagtccagttgtagagaggaggagtgatgagcaaaggggtcaagactattttgaagaacccacaggaagagctgacttgagcaaatgggaattcactgacttcagactggataacctgcgtaagactgaactaggccccctgaatgtgggtgtcagttgaggagttcgggcagtgtatggggccactggcagtggaaccagtatttatccctagtacatgaactggctttttagagcccattccctatggagggatatcagcccagatatgggtgggggagggagacgctcaatcttgccccatatgatgtgacagactttgataattccccatgggaggcctcaccctttttgaggacaggataaagggttcaatggggaggtggtagggggagtggaaggacaggagggagagggaacttggattgtaagtaaaataagattgtttttaatttaaacaaacatgtcaaaaaatcttaaatttattgtatcactatacaaaaatctatatcaatttctataccccttccccttttttcttttgggagtagattcaataatcttctcttatatcttatttataatccccgtgttttctttttctttccaggaaaagaacccaaaatctaatctcctttgtttagcttaaaagaaaaaacattaccaataacaacttctaatcaaccaccctaaacaatgacattctgagttcagcacatctttaaagtacacaggctgatttaatcctgtagtttttttctattatgcaatgtctctctgcagctgttgttcatttcacgttagcatttaggaaattcaaagttaagaaagcattatgcaatctatttctggatgtctttattaccaatttctgtttatttagcatattctttagagttctgtttgatctttccataactgcttgccctataggattgggtggtttacctgtaataagctttatattgtaataagcaaaaaactgtttcattttactagagacatatcctggagtattgtcagtcttaatttgtacaggtataccctgacttttctaagtatacccatgatggccataacttctagcaaatgtgtgattacagaatcagccctttcagaactcaaagcagctgcccattgaaatcctcaataggtatcaatggtgtggtgttacatattttaagtttccaaatactaaaaaatgaaacacatccatctgccagatttcatttctttgaatactctttgggttacttcctgacagtagtggagttaggttatataaagaacaagtaggacatttccttataatttacttggcttcttgccaagtgatgtacaaatattttttccaaacctttgctagtaacatgatttttttttatgaaaccctgagaccttcagcatatttcttaccaatagttgatcaattttatcattaccttgtgctagagggcctggaagacccatatgggatcagatgtcagttatatgtaatagatgattcctatttctgattatttattatagttgaataaacgaggaagttacttctgtatcatttggtataaattcaacagtttcaatgcataaaataactcagcatgctgagaggcagtaaatatgttaagaggttctgtaaaatccattaataccatgagaatagcatataattctgacttttggacagaaccataacagctttaagctactttgcttaaattttatgatttgtaatctgcctttcctgatttatttgcatcagtatagaatgtagggacttcatatattggtgttccctgtacagtgcgaggaagaatccagttagttctctttataaattgaattcttgtgtttttgggatatttgttgttgatatctctgaaaaaatcactgtaagctctttaccaagtttcactttctgcctgtaatttgttaatttcatcattagtaaagatactacaatttctgctgggtgtatttctgctaattgatgaagtctcacttttccctttagaatcaactcagagactttttccacaaaagtttttaattttttactgtttttgtggtaaagagatccattataagataatatcttccctctgcattaatatccctggagaaaagtgcttagagggaaaacgaaatacaataaagctttgcatccaaatgagccatatgtgcatcctgtagttgcttttccaccaaagccaattctttctcaccttcagctgatagttctcttggactacttaagtccttgacattgcaaaaggttttgaaataattactcagttcattttttacctcaatcatgggctgtagatagaaaatatctcctagcaatctttgaaagtcattaagattatgcaatttatttatcctaatctgcaccttttggggtctaacttgttgtagacctattttatatattaaataattaatagaatctcctctttgtgatttttcaggaatggtttttaatcctgaaacattaaattaacaaggaaatttttctttacttcttcaaacattctttctaaaatatctacatttgaatcagctagtaagatgtcattcatgtaattgtaaactatagattgaggaaattgcttctgtatcattttcaatggctgccatacaaaatattggcgcagggtggggccatttaacattccctgtggaaaaatcttccactgttatctcttgacaggatgagaattattataaataggcagtgtaaaaacaattttttctgtctttttcttgtaaaggtatagtgaagaaacaatgttttaaaattaataactataagaggccatcttttagataatagtgaaggcaaaagaattccagactatagaaagcccattggttaagttaccttattagatctgttaccattctccattttccagatttctttttaacaacaaatgcaggagaattccaagggctggttgattcttcaatatgctgagcatttaactgttcctataccagctgttataaggcctgaagtttctctgttgttagaggccattgctcaacccatacaggtttgttcatgaaccattttaaaggtagggctgttggtgcttttggaagagtagcaactattgtgccctgttcttgtacaacctgaatggttgatgactattctttataacaccttctaatattttccccagaaacataggttaacttatggtttgcttctaagattggaggaatgttaatctgagcattccattgctgtaacaaatcacatccccataaattcattgctatgtagccacatatggctttaatttttctctctgttcttccagcactatacattcaacccatctcatgctctgctttacctgagataaagttccagtcactaaaagctgaacatttacctcctgaagaggccaatttggatgccaagattctggtgcaattattgttacatctggacctgtatccaccagaccttcaatgacgtcatttgctcatatttttaattttgatctttgctcatttgtagaagtttgccaaaatatttgctatacagcttctcctgaattttttgtttcctcttctatagctgctctatcatccagagcaatacaatttcttacaataggcattaggttctttaattgctctagcaaatagtttcaggaaataactgaactgaatttggcatgggggcctgcaagaggcacctcaagaatttcacaattgcaaaggattgcattgactgtcccttattaatctgcattcattagtccaatgactgcctttgccacacctttcacataatccagaagagaagggtgttctgtttgaattttgcataaaaagtttgtttttaggaatatcctgtttataaacccttttaaggtggtcttgtttgccacaattgtaacacttgacaattcaattgttcttcatacctgtggaaatcacctctcctatccaagcatcatcatggtcatgatattcaatattgactgtatctcagatccatcccttcaaggagtgcctttaatggcctaattactattttgcattgtgcattaacattttcaaaagtcatagattcaattattatttgtcttgcttctgaattttgtatctttctatttactgtccaagtcaatctttgtaagaaatccatgaaagcttcctttggaccctatataacattagtaaatgactcaaatttctttcctacttctccagttctttcccaagtattcaaagctgctgtgtggcataaaaatatggtgtggtcatcacatagagattgcctttctacagtagcataatctccctctccatgaagttggtcttggaagatttccatacctctatccctaattccttgttcaataattttagcctcatctttctaccaggtcctccattgtaattgaggaccagactccaaaactgctggaaccaagtctttacagtcttgaggaataattctgttgggacctttttggggtcttctgatcatcttgtgactaagggtgacccattgtgcccttggggtccgctgattgtctcatgactaggcatttacttccttgttccctcctttccaacgaggtctatatgcaagaacacaaactatgcacctatccctatttcagggggtgggtttgtgggtgtgatcctctgacctgagtaaaattccactgtggtttctgtttggtatataagtttaatcccctttgtaataaacagcattctccttgcaagaatgaacagctgtcttgtctttattcaatccccagatttctttgcccgaatccatgagaagttgtagggctgacattacaacataattctattacaagttgatcaaaagtttaacatctgcttcacaaaaggtgaatgaatgccatatgagagtatttcttccttgaatctccttaaatctaacattttctgaaggagtgtgtttaactcttgcacaaccttggggatatttatcatttggcagttgttcctgtaaggtgattagataaatcaaagtttgttgtttgaaaaacttaggttgttcctatctaaccttataatgcaatgctgaaattggttctccactaaattctctatttgggtctgactacttttatgatctgttttgttatgtttttctgtaatatgtattttaacactcatattaatcaactttttaagtgataaaacaaaaatgataaaaagtgataatattaataattgacattacataaatcccatctaaattagttttcttctcatatggtttaaagataggtacgactgctggttacttttctgtcctactaacattcatagtactttccaccactataaaatctagcagggctgaagcctgtaggttgtttccagtttaatttctttttaaactggttttgttgggaaccatgtggcagaaaattcacagtgagaagcaacaataagcatgctgtgatgtcttccaacctgtgttgctgattactggaaaactgttatgatcttaaccaagcaactgatggtagagttggtgcttcagaggaaaattgaagagtctctcatctattctagctatgatgaaaattcaatttacagaaacttcagacatacctcaggcaaattaaaaatgcttttttaaaaacaaacaaatttaaacaataacaaaaaaggataccctcaaacactttttttacttcaattacttaaacattcttgatgttattgaattactcataataaacctttaatagaactgtcttagagttttgattcctggatcttagcatggatcttgaatcatgactaacttttaattaggaaaaattaagcaattgttgcagttcaatctgaaaaactggcgtaaggtaggagggtagtatgatgactaaacttggttggcaacttgatacaattgggaggaggaaacctcaactgagaaattttttcatcagattggcatatggacatttctcaattgatgcttcatgtgggagggcccagctcagagttatcagtgccatccctgagtaggaggtcctgtatttataaggtgaacagtcatgaagaacaagccagtaagcagcattcctctgtggcttctgcttcaggtctcgcctccatattcatgttctgcttgatcttctactctgatttcctttgatgatggacaataatgtggaactataagcagaaataaccctttcctcccttagttgcttttggtaatttttttttctttttttttttctgagactgggtttctctgagactttggaggctttcctggaaccagctcttgaagagcaggctggtctcaaactcatagagatccacctgcctctgcctcccaagtgctgggattaaaggtgtgtgaccaccgcccggctggtcatggtgttatttatttatttatttatttatttatttatttatttatttattattttttaatcacagcaatggaaagtctaaaaagcacgaatgttgacaccataaagattaaggctattaaattaaccatttactgattcaataactagaaatatatatatcaatcataaccaattttattttcatttatttgtctggctgatcctttaacccactaacctatgttaaatgtattcagtaattgccaacatgcaatatagacacaatctatctcattcttgacctcctagaacagtattcttctcaagcagaaatggataacagatgacaaatgttacaaagctgaataattaattggcatagttggaattctgaagattaatagatcttttgcaggtaaaggaatttaaggttttttttttttttttttgccctaagcatttgttaattttcagagtctatgaatgtagctaggatacaagctccatgagggcaaggattttgcttttttaaaaataacatatgttcaagttccttgaaaaagtacttgctgactgactcttggagccaggtgggataaggaattaacttcatttcttggtgcagcagcaaggtaagtgattaggggaagaatgttttgcttcgacctttacactagttggtacctagggggctcagatcttttctcttttgggggaaatgacacccctgacaaatactacttatctcttctaatacttctagagaggtcttagaaggtttggacataatggaggacatccttaagttctgttttgaatgggtatcacacaagttactcaggttggtcctattagcttgtgcatacaagactccagttagtggttgatgagtctcaatttctattttatttaatttgaaagacagataactattagaatctttgtgaaattctaccaaaacttccatggataagattcctgatgtattttcttttttctagatgcaaaataaaggatttagttaagacacaattctgagtagtgggttttgtttattataaccccatggattttatgacttatggctctctttatgaaagttctaaattttttgtggaccacttgttactaaaattccatggacaattttaaaattaaagtgttttgctctcttaggcgatagagctgggagagtagaaaatgtaatttggttctcgatcacaactgttttcaaaatgggaaattttaagaattggactgccaatgattctggatgactacagttaatattgcattcctcattagacttggcaagatctgtttatggagctgggcatgaaaagctagaaagaaataatcagaatgaagaatgaaatatttatttgggatatatctactgtccaaatcttcattgttttatttctttttaaaataagttttatttaattagaaacaatcttattttacatatcaatcccagttccctctccctcccattctcctatgtcccatccctgatccactccccagggatggtgaggtcttccatgagggatcacaaaagtttgtcaaggcatttggggcagtgcctaggccatcccccatgtatctagactaagagagtatccttccttggggaatgggctcccaaagtccattcatgcactagggatgaatactggtttcactgccagaggccctatagactgcccaggcctcctaactgatacccacattcagggagtctgattcagtcctatgctggtgccctagctgtaagactggggcccatgaactcccactttctcaggtcagctgtttccgtgggtttccctagcatggtcttgatccctttgctcattactcctccctttctacaactggattccaggagttagaataagtgcttagctgtggatctctgcttctgcttccattagctactggatgaaggctctaggatcgtatttaaggtagcctttccactattgcttagattcttagttaggggtcatccttgtggatctctggacatttccctagtgccagatttctctttaaacctataatggctccctctgttaaggtatctcttttcttgctctcttctattcattctccgaatcaatcttcctggtccctcatgttctcctctccctcctcttgtcccctcctctttctcctacctccatccccccattcccccatgctcccaatttgttcaggagatcttgtcccttttcccttttccaggagaccatgtatgtctctcttagggtactacctgtttccttgcttctctgccagtgtggattgtaggctggtaggctgttaatactttgctctatgtctaatatccatatatgagtgaatacatgccatgtttatctttttgtgactgggttacctcatcaggatggtttcttctagtccatccattttcctgtgaatttcaagatgtcatacccccaccccccacccacgccactgagtacttcattgtgtaaatgtaccatattttctttgtccattcttcagttgaggggcatctaggttgcttccaggtgtaaacttcctcaagaaggtaaaattgatattagtaaaaattattaaacagttggaaaactaataaaatggtaaataattgctgatgaattagtaaataaagccaatatatattaaaaataacttctagcttctgaaatcatggaaaacagtaatattttatccaagcagtgagagatacattggagttctctgtgaacctggtagtgttccttgaatgcagatgatgtgtaacatatttctaaatctctctagaatctcaatttgccgcccagggatcagaatgagcattaataaccatgataaaattaggccagatgaacatatgtagcatttcagttgtttttcctcagagcaccaagcattaggaaccaaggcccaggccagctgtatcatcatattcctcttaaaaataagttatttgaataaattgaatttgaaatctcattgtcttattccaggccacaatgctttagtgaataatgaaactgcaaataggatgatttcttagtggcattagtaatgaattatcaaccaatgaaatctgtcttactaagaaattacacaatttttgttgaacttaaactttatgatttgtttttttgcttaatatactaaatctaatcattttatatcatgttttaaaattagttccccaaccatgaaagaagagctatatttaaaacctaaagtcggtgttacttgaaaccagtgtgatggggttgtttgtcctcattgggagcattttctacttgacattgataaaaagaatttacacaatttaccaggtcagagactgggagaatttctagaaatctttactgaatacctgtaaaaagactgaggatagacaaagacctaattgtgagtttacaataataactgaattacaaatttgcttttggcctccagtgagtgacaggagaagtaagaagaaagagattcacaacccttccctatgttttaatacccaagaaaggctttcactgtcaggtataagtacatctattcaaaagcaaggtcttgaccaaacttactataaaacattttctgtgtatactacattaaaaaaagatgaattaacaagagctgaaaatgctgagggataattgttggctacttaagcttttaaaatatacaattaaatatggtgcatctgtaagatagttcagtgggtaaaagtgattccttcttttttattattttaattactcatatttacatatccacccccacataccctcaccttcccatcctcccatgttccccactccacccatcccaacccacccctgacttctcctcagggatagtgaggccctctaccaaggaccttcaaagtctgtcaaattgtttgggcgaggatctagcccctccttgctgtatctgggctgcaatagtatccctccatagggaatgggttcccaaagttcattctgcatgtctctcaatccctgtcttggctcctttgctcagccctcctccctctccacaactgaattccagtagtatggttcagtgcttagctatgggtgtctgtttctgcttcgaagagcaactggatgaagactctccttcctctccctgtccccgggttccagtttggtcagggtttcttgtccccatccccttcttcgagggactatgcaatcttcttttagggttcttgttgtttcctagctcctctggcatgtggaatgtaggctagttatcctatgctctatgtctaaaaatcaaaaatgagtgagtacataccatgttcatctttttgtgattgggttacctcactgaggatggtttcttctactgtccttattgtatgagtgtgcattctttgggtatattcccaagaaagggattgctgggtcttgaggtagactcattcccattttccggtgaaaccaccttactgttttccaaagtgtttgtacaagcttgcattcccatcagcaatggaggtatgttcctctttctccacatcctctccagcatagattgtcattggtgttactgattttagctgttcaacaggagtaacatggtatctcagaatggttttgagttgtgtttccctgatggctaaggatgttgagcactttctcaagtgtctttcagccattttggattcttctgttgagaactctctatttagttctgcactccatcttttaattgcattgtttggcattttggtggctagcttcttgagttccttgtatattttggtgatcaatcctctgtcagatgtggggttggttaatatcttttcccattctgtgggctggcgttttgtctttctgactgtgtcttttgctttacagaagcttctcagtttcaggaggtcccatttattaattgttgatctcaatgtttgagctactggtgctgtgtttagaaagcagtctcctataccaatttgtttaagggtgccacctaccttctcttttaggaggttcagcgtggctgaatttatgttgaggtctttgatccatttggacttaagtttaatgcatggcgatagatatggatcaatctgcaatcttctacatgtctgaatctagttatgccagcaccatttgttgaagatgctttcttttttccattttataaatttagcttctttgtcaaaaatcaagtgttgacaggtgtgtgggttaatatcagggttttcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcattgaatctgtagattgcttttggcaagattgccatttttactatgttgatcccacctattcaagagcatgggagatctttctattttctggtatattctttaatttctttctttaaagactcaaaattcttactacacagttctttctcatttttggtcagtgttaccctaagatattttatgttgctagttgctattgtaaaggtgatatttctttgatttctttctcagcatatttatcttctgtatatagcagggctactgatttttttgagttaatcttgtatcctgccactttgatgaaggtgtttatcagctgtaggagttccctggtagagtttttcaggacacttatgtaaactatcatatcatctgcaaacagtgaaaggttgacttcttcctttccaatttgtatccccttgatctccttttgttgtcttattgctctagctaggacttcaaggtcaatattgaagagatatatagagagtggacagccttatcttgttcctgattttagaggaatcaccatttagtttgatgttggctgttggtttgctgtatattgcttttatcatgtttaggtatgttcctgttattcctgatctctctaagacctttatcatgaagggatgtcgcattttgtcaaaggctttttcagcatctagtgagatgatcatgtggtttttctttttcagtttgtttatatggtggattacattgatggattttcatatgttgaaccacccctgcattcctgggataaagccaactttatcatggtggataatttctctgatgtgcttttggattcaatttgccagtatcttgttgaatatttttgctccgatgttcatgagggatattggtctgtaattctcttttttcattgtgttttgtgtggcttgggtatcaaggtaattgtagccttataaaaagagcttggcaatgtcccttctactgctgttgtgtggaacaatttgaggagtactggtattacctcttctttgaatttctggtagaattctgcagtgaaaccatcaggccctgggctttttttggttggtagatttttgatgactgcttctttttcattaggggttataggtctgtttaacttgcttacctgttcttgatttaattttggtaagtcatatctatacagaaaattgtccatttactttagatttttgaattttgtggagtacaggttttcaaagtatgacctgatgattctctggatttcttcattgtccctatgttaattagcatgctctatctctgccttttggttagtttggataaaggtttgtctctcttgttgactttctcgaagaaccaactctgtttcattgagtctttgtagtgttttcctaatttattgatttgattatttcctggcatctactcctcctgggagtgtttgcttccttttgttctagagctttcagttgagctgataattctctagtgtgactattctccagtttcttcatgtgggcatttagtgctatgaactttcctcttagcactgctttcaaagtgccccataggtttgggtatgttgtgtcttcattctcattaaattctaggaagtctttaatttccttttttatttcttccttgaaccaggaatggttcaattgcccattatttaatttccatgagtttgtaggatttctgcaatttgtgttgttgttgaattctaactttaaagcatggtggtctgataagatacagggggctattccaatttttttgtatctgtgtagatttgctatgctgctgagtatgtggtcaattttagagaaggttccatgtggtgctgagaagaaggtatattcttttgggttcagatggaatgttctatagatacctgttaaacccaaatgggtcataacatctgttagttcttttgtttctgtgtggtggtcctctatagtggtgagagcggggtgttgaagtctcctgctataagtgtgtgaggttttgagctttaataatgtttctttcacaaatgtgggtgccttgtatttggggcatagatggtcaggattgagactttatcttgatggacttttcctgtgataagtatgaaatgcccttctccatatcgtttgattgactttaggttgaagtctaatttgttagatgtaagaattgcaggagtgcagtgagatatccaccctgctcacacctgtagtgctgaccacgactggttgggcatggtcacaagtgcagacgtgatgttgagtgagttttagatctagggtcgaggcaggaggttctctcttgcatccgatagggtcacagggagcagcctgtgcagatccttagagtgggaacctgtggcggccatctgcttcttatgtaagtgacttatccctgaaataaattatatttaacctgtatttgaaacctagtcccatgaatcattatctgtgcctcacacagaagagcttaggtaattactcaattcaccttacatttagactattttgagacctgtaaaaaaatgcaaatacaatgaactgcttatataagtattttgggtgtgttttgaattaaatgcacatcagatatcatataaattatatgtgggattataatccttaattagcagttgaaaaatggtatctcatttagtgaattgctgtagtgagtcctgtatactttatataagaaaattacatattaatgaaatacaacagtgctataaattactttaaaacatacaacatatataggacaaagtccagcagaatagaataccctttctcactgcattttgaccccaattggatggatacagtaaaaggtttttctgctacacctataattaagccaacaacatgatacaataagtcacctcattgaatattcctgtctctgtgttttagtacattacagttctatgaacagagaaatttattgccaaggtgctctttttcctcatcaggatgccttcttagcaagttttctgtcctcagaaacagtccttcagaaacttagagcagaacacgagatgtttcttttaaaatcccagcgatctcttgcacatgctgagacctcgtctagagggatgaggcagtgtaaattttgccttaggagatattgcagggctgtgcaaatacatggagttgaatatcacagttctcctcagtactacatgtcagcatgttatctaatttccaaaatgatatggctttcttgtcaggtactgtatgaagctcatctgttagaataaatgttaactgaactggaaataggctgaacaattttggtttaagagatgagggtaaaaaatattaagtataactgtgttaggcattcttaaggttcagaactgtcttcagaaggctgtcttcttttctttgttccccaccagtaaaactttgaaccctctgaagaaccactgtaatcatggggcagctgcagtccctttggaggctggcagtttatggtagtttttcttctcacattagtctcaactgacatgcccataaagagaagcctataaagggagcaaggtagggaatgtgcagttgtgcatcactgtggtgccaaacttcctgtgtccactggagaagggatgcctgaatgccagaacctcacttcttctctaatgcagtgaaaatagtttatatcatttacaaactgctttagttaaaacttgttttgatagcaccactgtcagttatggactgtataactttttaaaagttagcacataggtttcattactgaattttcatacatattgttgatgctgctccctttcttccctatctgcctgcctccctcctgtggccttcttccaatagcttctctatccgttcatgtcacatgacttttgccccccccaacctctctctcactggctttcaccatctctttgtcttgctttcactcgtgtactcccaccgagatgtctttttccctctttcccggttccatttaggctttatgatttacaatccctcatacatataagtatacctatacaaaaattaaaatctagcatctgaatatgagaggaaataagcagtctttcttattctgaatccagctttttttttttctaacacaattccagtttcacccatgttcctaccaatgccattatttcatgtttctttatagctgaataaaattgcatctatgtactacatcttctatattcatttacctattgatggatgtctgggttggttccatttcctagtattgtgaatacagcagctataagcatggctgtgcaagtaactcccaaaagtagtatagctgggccatgtggtagtaacgatttagcttttttttcttttgagacatctacatatgatttccatggtggctgcactgggtcatactccccattccatccccggtagtgaataagggttctttccccacaccatcaccaccatttgttatcatgtattttctagatgttagccattctgactatgatgaatgggatctcaaagtacttttaatttgtattatcctactggctaagaatattgaagacttttttaatagcaaaaagtaaatactcttagcaaaacaaataagaaatgataatagaaacacatgaaaatttattgatatttcaactgtgagtaaaaacttacatgcagtatatgaaagtccagaaagaatggataaaacatgaattacacaacttttgggcacttactatggtaagctggctagcttataaattttaaatttgctaacaattcaaatttaaatatgaaagcatgctatactttagaaatatggtacagaaaaatttaaatgtgaaatcgcccctccagatcatccactttcttggctagagagaaaataacattttctaatgtcctgatacatcaaagctaagtttctagatattttagtgattggatagtggccaccaatttcctaaggtttctctgtaggctgcttgtcacacacttctgtaagtggaagtttggtaactttaaatgaaagtgtgtaaagttttctttcctgagtgttattaactaagggactctggattaatttagcatccaggtctgttcttccagccataagccatgctgtcagggaaacttaattacactttaagtgggatgcaaatgagttgtgacactacatcatttcacgtgaaaggttcattacttacattaacttgcacaatgcttgctcccaagcctagacctcattacaatattcttgggattatttttttaaaacatatttaatgcaagtagggttttaacttttaatagcctgtttctttcttaacgttgtttaagactacaaatgttcactttattaaatgattatgagttgaacttctggtacatgaattcattaaatctgcaagggaaaaaaaggtaaattctattacatgttggcttcattgcatgtctcaggaccagattatcctttaaagccacactttgtgggttccttccttagcattcatactcatgatttgagacagaaaattaacatgccttaaaatcagaacgctaacaactttattctaagatttaaacagatatttttctgaacataatatgtaaattaaattaaataacttgtttcatattgatagattaaaacttgagtgacagagataaatcaattgtgattatctgacaaagtgttaaaataggtatacaaaatgtttgttcccactttgaaaaaaataggtaaatggttctggagagagaattgactttagatttatgtctctattctctgatgtgatgattagagacttttagaggaaattagttgtttctttttaacataatcagccaccataatcaatcaagattttgacagttattctcaattatatacaggtaggaaaaatgataatgaatatttattgaacacttattatgctcatggtaaagctgtatgtgctttgcttatataagctcaccacacacacacacacacacacacacacacacacacacacacacacacacacacacacacgagacacacatacacattagtactcaattcttgtattatgcgtgttgaaattaagagagggtttgaggaagtggttcaaagctgcatcacacatgtgagagacagggttcagtgacactctaaataagtctgtggcttcagacatactatgatatactgcatgattgtatgagaaatatttatattggttaaatatagcatgagagttttttaatagatgtactgtgaaacccagctaaataagaaaaaaagatctttactctgttaattgaggaatatgattagtgttagcaaatgatgtttgcatagtgttataattcccagaggtccaaatctgttacttattgtattgtaatatgctaaacactaaatgctgtttagttttaattcacaaatctgtctttccccacccttaaaagaagctcactatgtcagggccaggaagtaaccttatcaagtactgataaggtgtagtatgacaggatgttcccacttcatatgttactggaaatcatgcagtagagacagggaggagatcagaagccccccaaacaaagctattccctttacactgtctgttcagtgctcctggttgatatagcttagcattgtgcatgatagtaaaagaaatgcctacaggatccatttattaaatctgagaactagatagatgtgaaaagataaagtaaattctgcaaccctaacatcatgaagtatatatacactacactaaaatttaagctatatgaattataattaacaaggtgatattttggtctttaacaattatataacattcaaaacccaattctatttctttcttttatattatgatcagtacctttaggaaagctgatcctaaattgaggtgaccatgaatgcctcattgtctctgtctctctcttctttctctccccacttctgtccttccctcccccccacacacatacattcacattgtgtttggctacaaatctactcttcattgtatagtctctgctcatagagctggatcctgtaggcatttcttttactatcatgcacaatgctaagctgtatcaaccaggagcactgaacagacagtgtaaagggaatagctttgtttggggggcttctgatctcctccctgtctctactgcatgatttccagtaacatatgaagtggggacatcctgtcatactacaccttatcagtacttgataaggttacttcctggccctgacatagtgacatcttattgccagtatgaaccaaataagtttattaggattacttatagggttatggatgagtgcttacttataggagtgtgggtgattcaaaggtaaatgcatccctgaaaacatactccagtgtggttgatgacctgtgaaagttggaaccttagaattctctgtaagacttgcaggcatcatggcaagttggacagtctcctctcctcagcaaaatatttcactgctcatatagtcttgaggaggaagaggccttgtaaatctgttatgtataagggacttctggagacttgtgagttgtcccttcctggacattaaggaacctcctgagtcttcaagagcccccacccccttataacttccccaatctttgtgagcttccctcctatgttgcaattctaagaatattgatatacaatacagacacactcaggctttttcaagcacaaattctgagtgaaataaaactttgaactttaaatttgttagcaacataagtggttactaggatgctgttttgggatcctggctaacatactttggccacatggtctcaaccatgtgttcaaattcttaccacagttttctttcttgacttttactagaatgacttactatgcaggggcaaacctaagtgctgggataaatacatctttccagataagtttgctttcattatgttatgccctagatccaagtcctaggaacttctgattcaagatgtatagttatatttgttacgtatttcttcattccttcattacagaaatcatgcatatgtctatgtatttggaagtatgtgttttggggaacataaaagaacactctactcataagtagatttttctatgaatatatgtatttttattttgaacacagaagcagagtgaattaactacaaaggatgaaagttcacaacttatacaaaaattttcacatatatatgtatcattcaataacatatacatttcctttatgcatatcacttcctatatgcttatcacttactaattttgaagatacattttcttatacacttgacatagatattttgtctttcaattttgttttcaagttctaggtaattctagcaatcttttcattatgatcgacaccttaccataagcttagaacaatactacttaacattttaaaatgtattatttgtgtgtgtgtatgtgtgtacgtgatgtgtatggggggcacatacatgttccatggtgtgcatatagcaattagaaggaattttgcaggtttgattctgtcttctcacctttatgtaaatttttgggattgaattcatgatgccaaggtttgcactgtaagtacctttactgactgaactatctagccagcccctatagcagtatacttgaaatcaagattatacccatatttgcctttattaatataagtatatatgtttttattaatttatttttataatgaatacctcaccaaaattctaaagcatattttattatcaaatactgtagtattaattttgaatgtgattttaaatctgtgtaagtcagagattaatattaaacacaaagtttatttattttgactatcttttatttattcttggacagcttcatatctgggtgtatcttgcctgccaagtcagtattgtaatattcagggtttatgaatagcattgtacacagaaccttcaaatgctgtgagagttagaaagggtgttctcaggtcagttcaaacttgatttctctatgtcttttagccaaagtgtattgtatctccagcattaattataactgtcaattatagtgggcaacaatgaacaatagcctatttagggatttatagagaagacccatgcatggccctgagattttcactctacaacccatgttttctgtgcttctggaggaagctttttttttttttaactcaagcagagtccctgtgttcaaattacttaaaaaaaaattatgtattttagccgggcgttggtggcacatgcctttaatcccagcactcaggaggcagaggcaggcggatctctgtgagttcgtgaccagcctggtctataagagctagttccaggacagcctccaaagccacagagaaaccctatctcgaaaaaccaaaaattatatattttaaattaacataaaatgcatatttccattggattcttcacacatcttcagtttgggttaacttactcctatcccttttaaccatgaaaatttaaaaatggctattgatgaaatctaagattaatatgacatggtgaatatggcctttgcaaataaaaaccaaaagtttttgatgttagggcatttagagttcaccttccctagtgtcttgggatgcttttgacattgataaagtccagttcacagggatcaaatagtttactcatatccatttggggaggtagctcagaagctaatgtttttattccctaatctagaggctcccctttttctagattaaaaaaggtgacatccaaagcaactgaaaacccagtacttgttttctttaataatacattttcatttcagtttttttcatttcatgtatatacaattctaaatttcaataagaaacaaattacaaaatatgttcaacaatgggaaatgcaccagagtggatctttattgtttcacaactctgcatttgtacagctacagagcacaaataatgcatcattaactatcaaatctggccaatttgtcaaaaagatactgatgtttatagcaccattggacttggcattctgctgcccctcagcagcccacacctgaaaacttaaagactctttggcactttgtaacagtgataaaaaaaaagtgagttacaccattagagaagaatcttaggaattctccccccctctctctctctctctctctctctctctctctctctctatctctctctaagatgagatctcactatgtagcctgcactcatccagaattcaggctggtctccagtcatagagattcacctgcctaagcctcccaagttctcccaagttttgacattaaaggtgtgtagcaatatgcctagtagaaggaaattctgtatttcccattttggaccttagaaaagctgtctgtgtgatggttttctgatctagctgacctctctgaagggcaatgaatgcacattgggatttcaggcctgaaaaatggccctacatgtaatcatcactgttccattatcggcctttaatcagctctctttcctttcacttctaatcttattttaagatgattttctttttttggcaaaaatttcacactccctcccagtagtttttcctagaacaatatcttagaaagcagactttggaggaagtattattgcagaaatgagtttccttagcctctggctacttttagaatcagaccactttaaaatatgcctaagtaaaagctgttctggcatgcaacatggaaactccaatttgagaatttgtgatgtagattgaacaaagtgacagaatctccaaagctgatttttttctaaatcatcactcaaatgcttacagtcccatacatgcactaagatgaaaaatcagtgcaattgtgggggaaaaacaatggtttaaaacagtttggaagaaagaaagtatcccaataaatcacttgtcattgtggataatggaatactgcatcatctcctatcagccagaatgaaggttaaaacactgcttgctccctaaaccctgtgatctttctggcatattcaatagcagattccatcacgactgtccttttggtaaaggaaacacttctcttttctgtaattgtttgtaattcctgagatctctcagggaatgccatcttctttaataagtaataaatcctctgccgaatgtgttgagagctagtataatagcaagcaagaaagagatttctttttccagcaagcataaaaggctgacagaatgcttcacaaattatttaaaacattttgcattataagggggagttcagaaaagaaagattgtcttgctctaaaaaatggtaggtttcaaatacaaggttagcattgaagacttaatttgaaaaccttgaggtattccctccaggccactatctgcagcaatctatcacttaatccagatgttacttcttctgaagtttacctcttgactccaatctcttggtactttttgactcattcccacctttttattttttagaaaaaatttgaagacttttaagtgaaaattgtatgtgcacttaatttagagaactgaaatattcttttaaggttactagagaagcatctgtctgcagacacactccccactgtcttctactctaggagtgaacattcacctctctagctatttatgtgatgctcctaataaaatgattatagtgctgaattgagttgttctgtttcagttgtcatctcttaacctcccactacacaggataaagctataactctcctttcttcacctctccatcgtatatttattcctatacatgcacacattcataaatttatgcatatatttatgaatatacataatacataatatgaatgtatatgtaactgataccttctcaatggagttatcttttgaaattggataaatgaatatgtagagatttcacagtgatagccgggtaggttcaaaaagccaagttagtaaactacatgttactttttctgtattgcttttcattttctcacaaagaaacatgtcatttatttgatttacttttgttcttcaatgaactttcttaaaaataaatttaatcccctcttcagttgctcacatgatcagtactccataaatcactttttaaaagatttatttttattttttgtgtacaggtgtttttcctgcatgtatgtctgtgtaccacgtgtatgtctggtgttgaaggagggcaaaagagagtgtcagataccctggaacgtgactggcagatggttgtgagtcaaacatgtggatgctgagaattgaacctggatcatctggaagagtacccaatgctcttaacccttgaaccatccttctagcttcctatgaatcattgtttttggcagcaacttctcagtctgcactgtttccatatatgtctctctacaattgttacacattctataagttatataaatatttgataatatttttacaaatgtatatgtgttttataagccacctccattagttaaagaggttgtaccctgtatcattcagtaaaacacttcataggttcacaatgacattgattaattttatctttgaaaacctaaaataatattaaagaaaatatgtatttttgcatttatatacctaaacctggtatgttttatgattcatttatacaatactgattgtagtagttttcacttgtttttgtttaatgttatacatatgactagaatataaaatatctcatattttcttctataagattaaatatataatttatattaaatacttacacctatgatctctctaaaattatttttgcttgtgtcataaagcatggatcaagatttattttttatatggatgtctaatatctagcaatatttatgagaaaatcatggtgttctctatgtcgggggcccaaaatttatcgattataaagttttggggttcaaaactctgctctatttccaggtgcttgaatctcccattgtctttcagatgctggctaaattaccacttgaaggtttggcctcagtggagaatgtctcctagtttgcttaacaacagacataggccctgggtgtgcctgcacctgttctgagggttttgtttatgtgcctagggactgtttagttgcctctcggattaaaagaattacttgatatcagttttatacatgatagtagacgccttctgtggtcacccccactgttggaaagccatttaagaggatgcatgaataaaccagagactccagtctccatcatggactgagagccctcctgagatgacaagatgtgtctgtgtctcatccttaaagccttggggtagctaggagtttccccaggtctatgcaactcactcagggatggacccaaggctgtttggatggctccaattaagccccaaagatatcagtcagtccggaacagatggcctttgtagcatgggactgatacaagctgggtcccggcagctctactgaattgcaggagcacctttgaggtaaacaggatactacctgtgtagatgtttatctatcctatattctcttgatatatttgtctgtctggaccactaacaatgtcttggtagttgtagatttatgataggtttgatgtcttggttatttaggctcctctacattttacatacattaaaagtcccagtctacagtgtccacccaaaccaaaccagaccaaacctgtccaaatcaaactaaaccaaaccagatcaaaccaaacacaactgagacagaatcaaacctagagcctctttgggtgggaatttatattttactagtttttattcttcttattcacaaatatcatttcactgacttagatatcctatcatttctctcagtactattcagtggttttctgtatcttatgctgaattcattatactttctgtttgaattttatttaagcttgttttcatcccatatttttgatggttctaggaatgactattgtttaaggtgtcatttcttgattatttattcataatataagacacaactaatttgtgtatgttgaacaggtaggtatcctaagcccttactcattttgattacttaaataatttgttttctggaatattttgaatttaatgcatatataaagtatcatttataaataatgacaatttcaaatttttcattttagttataccttttatatgttcatgtagtcttattataatgtatagaacctccccaacagtacttaacatatgtggtgatagtgaagagtctaagttttcttgctctacttgccttagggagaaatcattcagtatttcaccatgaagtttaatactacatataagttttcttcagtgcctgctctcagtttgagaaatcagagttttcttattgctagcttttgtgagtttctggtatgaatgaaaattgaattttatttattgttttcttagtctattaatatattgctttagtcagtgttctatttctgggacagaattcataaccacagcaactcttatgaaaaaaagcatttaatttgggcttgcttatagtttaagagatttagtgcattctcatcatggctggcagcatggtagcatggtgctgcagaggtacctaagagctctacacattgatccacagatagcaggaaaagagagccagtaggcctggcttttgcttttgaaaccttaaagcccacccccagtgacatacttcctataacaaggccacaattcctagtcttttcaaatagtgcctttcaaatactggtaatcaagtattcagatctattaatgtacaggggaccattctcattcaaaccaacacataaatatttatataacatataatatttatattaattttactttatcctgttgatgtataaatatgtgctggttgtgattcaaatcttaaactaatcttgcattttgagaggaaactcagtgttgatgtattacttggttaatatattgctctgctttttactagtattttatttaacagttctaacccataagagatactactggatttttattttttgatgcctttatcaggtttgagtatcaggattacaataatttcacacctgaacagtagattagttggttgcagaatactaggttggaaataactttccttaaaaccttgaaatattgtccttctattttctaatatccaataaagtcttgaaagaatgaagtgactgcgatttatattgtagcttctgtgttttcattgtgctgggctttattgtggctgttttcatcctggttgtggaaagtgaggtatctttcaagcttgagatgaaaaccatttagctgtgagagccttcatgaatatttgtcataacagttaagcaatgccccacctcaccattccaaagagggatgtgttaactgaaatagcagaaaggacttccaagccataataaattgtggtgtctgaagatggaagaattactctggattgtgtgagtagactaaggcagaaggtcacagtttcaaagaagccaatgtggtgacagaagcagaggttaggcacagtcctctgaggatgggggaaaggtcactaaaagcataagcagtttccattagctgaaaaggcaagaaaactgatttctccatagagcttcctggaacatccaacatcttgacattggcctagtactggtaggctttgctccatatgggttcgttgacctgggatgtttgtgtggagtctgcaccaagaaggaattgtgacaacctgttgttcagacaaatggccctggatagcttcaatcatctttatttatatagtttcaatatttgcatgaagagttctacaaccagtttttacttcctaagttttgaaaactggctacaataattaccagtttgttctttctctttccccttccatctcccaactctcccatggttagccattaccttttaaatctatatatctatcatcagaaacataagcaatcctgcaatctacacaggaacttttccaacaaggaggacctgtgggtcgaacagtatgcccagttggcagcacttgtggttacagcatcatccagagtgagagacagctttgcttctgtggttcatatttacatctggtagggtctaggttctcatgatcatctcaccagccaaagctggacccacccattctagatttttctattgttctatttatatttttaaaatttatataaaatttatatgctcgtcccttctccttatgtctatctctcttaacttcttggggtattggcacagctattagaaatgaggagtgttacgataaatctttccaccataagccgcctgagccccactgccacgtgtgagctttacgacagccgcctgcccgagttaggcccaaatgaatacacagagagacttgtattagttacaatgctgcttggccaatgactaggattcttatttgttagctcagtctcaattaccatacatctatatattttatgggacttatcttattggacgccttattggcgtccctcctttctggtgaatcacattgtgccgctggagcaggagccgaggggaaaagaaaagagagcgagacttcctttttcctcttcttaaatatgagtctccttgctatgtcacttcctgtctggaacaccacttctctactacatttcccagaatcctctttgactcctagtccagcctaacctgctgtctcattggccaagcaagtactttatttataaacatacacagaagtatttcccccatcagaggggacagtgggtttctgtgattctgcttcattccctgtttctagaatgttcccatttagtagcatttctttaaagctcttatggttaaaaccattattccagaactgttatgcaaacatatttcattaaacttcatgatactgtgactcgttcaaaccagcagtatgtctagcatagtgaaagcaaggatagcatatagcacatatactctgtggacatgtgcagaattatgcagtgaactctccacaggttcttacaaagtgggccagggtctccagtgtcttctacaagaagagccacttgtgctgttcttaggcattgttccctgaggaaggttcatggctcccactagcctagtaaaatttattttagaggtcatgcatctggaactagaatgattgtaatagactgatattgttgttataggcattgggaaataataaattgaagtttgttcctctctgtcttctgttttttctttaggaactcctatctaatcatcacttttgaccaatcttcaggtttttcatcttcatttaatattgtttcctctctaattttctagaacatttctttttttccattcatttattaagctcataaataaagtcatgcacaattatgatacagaatacagtatgttcacaatggcatggctaggttctgtagtcatttgaacaaaattgtagagacatctagcacactccatttaaaacaaaacaaaacaaaacaaaaacaaaaaacaaacaaaacaacaacaacaacaatgtaaaaaacaaaatcccagaaaacagcacagttctgttactcttgtggtacttggcaccattttttttaattagcttctcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggataacctaaaagcccttcccctaaaatgagattgacgacttctctttatgccatcctagagccctcatccagtggttgatggaaccagagacagacatccacagatatacactgagctgaaattgggaatttagttgaagagagggaggaatgaagggtgaaggggtctgtagcaggttggagaaacccacaggaacagtaggcctgaacaagggagagcacattgaccccagatgctgtcagggaggccagtacaagactgatccagacccctgaacatggatgtcaataaggaggcctctgcactccagggagcctctggtggtggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcccaggcccagcacaggaagatttggtggactttgcagtgcccctgttgagggccctaccctgcctggggagtggtgggtggatggagtgggaggtggtctgggggtggggaaggagggttgggggaggggagagagagggagaagggacttacatgtgaaacaagcttgttccctaactggaactaataaataataataacaaaaaaacagctctgataaagcatggtcacatatgagtgagtacatatcatgtttgtctttttgtgttgggttaccttgctcagaatggtttcttcgagttccatccattttcctgcaaatttcaagattccagttttttattgctgagtagtactccattgtgtaaatgtacaacaatttctctatccattctttggttgaggggcatctaggctgcttccagtttctggctattacaaataatgctgctatgaacatggttgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaatgttcaggaatcggtctcctgtaccaattaattcaagggtatttcccactttgtcttataatagtttcagtgtagctggatttatgttgagatctttgatccattttgacttaagttttgtgcaaggcttgggtctaactgcagtcttctacatgtctgcaaccagttatgtcagcaccatttgttgaagatgttctctttgttacattgtataaatttggattgtttgtcaaaaatcaggtgttcacaggtgcgtgggttaatatcagggttttcaattctattccattggtctgccagtctaattttgtgccaataccaagctgttttctggactatagctctgtaatgagcttgaagtcagggatggtgatgcctccagaaattcctttattgtatagggatgttttggctatcctgggtcttttgtttttccatatagagttgagaattgttctttcaaggtctgtgaagaattgtgttgggattttgatggggattgatggaatctggtagattgcttttggcaagattgccatttttactatgttgatccgacctatccaagagcatgggagatctttccattttctggtatcttctttaatttctttctttagagacccaaaattcttaccgtacaggtcttttatttttctggttagtgttactccaaggtattttatgttgtttgtggcaattgtaaagggtgatgcttctctgatttctttctccaccaatgtgtcatctgtatatagtagggctacagatttttttgagttaatcttgtatcctgcacagcctctgctggaagcactgaactaggacataaaaacagcccccaggagcagtacaggtcatagacttcaacatgatgttgggttgcagcagagaagagagaaatggtccatgtggtagtcctgatcctggatatcaacatggcctccagagaagcacggaccatggacactaacctagacattggtggctgcacaaaccatagacatcagcacattcctagatagcagcacatgcccacacacatcaacatggtctcttgtggcaatatggactacagtcaccagcattgccctcaacagacattggcatggcctcagaaaaccatagaagagggtccttaaaaattgtgataaagtgaaatctgtccaaaaattgtccatttcctttagattttcaaattttgagaaatacaggttttcaaagtatgacctgatgattctctggatttccactgtgtctgttgttatgatccccttttcattcctgattttattaatttcactctttgttgtttgttaagtttggataaaggtttgtttatcttgttgattttctcgaagaaccatttcttcatgtgggcatttagcactatgaactttcctcttagcactgctttcagactatcccataggtttggatatttgtgtccacgttctcattgaattctaggaaatcttttttgtttttgtttttgtttttgtttttcgagacagggtttccctttgtagatttggagcctatcatggcactcgctctggagaccaggctggccgagaactcacagagatctgcctggctctgcctcccgagtgctgggattaaaggcgtgtgccaccaacgcctggctaattctaggaaatctttaatttcttttttatttcttcctggacgcatgaattgtgcaactgggtgttacttaatttccatgagtttgcaggttttctgtagttcttgttgttgttgaattctaattttaaagcatggtggtctgataagacacagggggttatttcaatttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatgctatcccttttttcttttgactgttgttaagttgggattatctcttgcctatgtttttctagttgtagttaacttcactgggttgcagtttaccttccagtactttctgtagggctggattggtggatatgtattgtttgaatctggttttgtcatgcaatatcttgttttctccatccataatgattgaaagctttgctggggatagtagtctggctggcatccatggtctcttagtgtaggtagaatatcgatgtatgcccttctggctttcagtgtttccaaggaaaaatcaggtgtgactctgataggtttgcctttataggttacttgacctttttcctttgctgctcttaatattttctctttgttgtgtatgcttggtgttttgattattatgtggtgatgtgacctttttttttttttttttggtccagtctatttggtgttctgtaggcttcttgtattttcattggcatttctttctttaggttgggaaagttttcttctatgattttgttgaatatgttttctgtgcctttgagttggatttctccaccttcttctatacctataattcttaggtttgctcttttcacagtatctcataaatttcctggatattttgtgttagggatttgttggacttaagattttctttggctgatgaatctatttcccctagtgtgtcttcaacttccaagattctctcttccatctcttgtattctgttggttatgcttacatctgtagttactgatcatttgccctgcttttctatttccagcattccctcagattgtgctttctttattgtctctatttcagtttttaggtcttgaactgtttcttgtattttttggtttgttttgtcttcaatttctttaagggattttctcaggtcctctttgaggtcctctatcattttcctgaaggtgtttttaaggtcattctcttctggttcatctgcatcgtgatgttaaggtcttactggtgtatggttcctagtctctggtggtgtcatattgggttttctgttgttggatgtgcttttaccttgtcctcttctcatcctttcttctggtgagtgtaccaagtgtttcttgttctcctggtgggtgtgggaccatggttcccttctggtagatgcaaacagatccaatactttgatgttggtcttctactcatggatggaggtgtcactgttaccccggtgttggcaatgtccaggcgtgccggattctgccagcgggcagttggaggcagaggtgtcaccgggcctcggggtgtcagatcctgctgctgaactccgtatggtcgcttgtatcagaggacttgagcagcaatgacgagcaggagccagaaacagcccctggcctacctgggctggtggatggaggccgggctgcctctgggtgtttggtgttcggaacccaccactgccgaactgggtacctagaacatttcttaaattcctctttaggctcatccttttgaagatgttctttatttcctttttttttttttttgcagattttttaaaaatttaaattagaaacaagattgttttacatgtcaatcacagttccctctccctcccctcttcccctgcgccccacagactccctatcccatcccctttctgcacctccagggagggtgaggctttccatgagggatcttcaaagtctgtcatatcatttggagaaaggcctagacgctccctgtgtctaggctgagagagtatccctctatgtggagtgggtgcccaaagtccatctgtgtactagagataaatactgatccactacctgaggccccatacattgcccagaccttcaaaatgacatccacattcatggggtctggatcagtcctacgctggtttcccagctatcagtctgggatccatgagctcgcccttgttcatgtcagctgcttctgtgggtctctccagcctggtcttgacccctttgctcatcattcctccatatctgcaactggatttcaggagttcatctgagtgtttatctctgggtgtctgcttctacttccatcagctactggatgaaggctctaggatggcatataaggttgtcatcaatctcattatcagagaagggcatttaaggtagcctctctactattgcttagattcttagttagtgccgtccttatagatctctgaacatttccctagtgccatatttctctttaaacctataatgtctccctctattatggtatctctttccttgctctcctctattcttcccctgacacaatcttcctgctctctcatgtcctcatctcacctcctcttctccccttctctttctcctaactctctctctcttccattatgttcccaatttgctcaggaaatcttgtccctttccccttctttatttttttatattttaattagaaagaaaattattttacatgtcaatcccaggtccctttccctccccacctcccctgcccccccaactaacactctacctatcccatatgctttatgctcccaagggagggtgaggccttccatagggggtcttcaaggtctgtcttattctttgggatagggcctaggccaacccccttgtgtctaggctcaaggagtatccctccatgtgggatgggttcccaaagtccattcctatataagggataagtactaatacactacaagatgtcccatagatttccaaggtctcctcactgacagccatattcaggggatctgggtcagtaccatgctgatttcccaggtatcagtctatgcaccaagagttctcccttgttcagatcagctgtttctgtgggttttaccagcctggtttggacccctttgccatcagtcttccttctctgcaactggattccagtttagttcaaggtttagctgtctgcttctacttccaccagctgttggatgaaggctatatgatgtcatatgaattagtcatcaatctgattatcaagaaagggtgtttaaggtagcttctcctctgttgcttagattgttagttggcgtcatttttgtagctctccaaatatttccctaaaccagatttaaacaatatgttaccactaatccagccctacagaaagtactggaaggaaaactctaacctaaggaaattaactacactcaaaaaaacataggcaatagataatcccactttatgaaaacccaaaagaaaaagcagggcaaatccaaatacaatatcactaccaacaacaaatcaaaaacaaacaagaataagcactcaatggtccttaatttccctcaatatcaatggtcttaacttgcctataaaaagacacaggccaacagaatggatatgaagatagaatccatccttcttctgtatacaagaaacacctcgaattcaaagacagacattacctcagaataaagggttgggataagatagtccaatcaaatgaacccaagaaacaagctggggtagctatcctagtatctatcaaattagacttcaaactaaaatcaatcaaaagagatgaggaaggtcatttcatattaatcacaggaaaaatccatcaggaagaagtctcaattctaaacatctatgccccaaatacaaaggcaccaacattcgtaaaagaaacattaatactcaaatcacaaataagacctcacacagttatagtgggaaacttcaacaccccactctcaccactgaactgagattatttattgcctatactttcctgattgtacttaacttcctttggttgcagttttccttccagaactttctgtagggctggattggtggatatgtattggtttgaatttggttttgtcatgaaatatcttgttttctccattacttgactttttcctttgctgctcttaatattttctctttattttgtatgtttgggggttttgattattatgtgtacaggagaccttttttgtggtccagtctatttggtggtatgtaggcttcttgtactttcattggcatgtctttctttaggttgggaaagttttcttctatgatttcgttgaatatgttttttgcacctttgagttggatttctttgccttcttctatacatattattcttaggtttggtcttttcacagtatcccatatttcctgtatattttgtgttaggaatttgttggacttaagagtttctttggttgatgagtctatttctcctggtgtatcttcaactcccgacattctctcttccatctcttgtattctgttggttatgcttacatctgtagttcctgatcatttacccaggttttctatttccagcattgcctcagattgtgctttctttattgctggtaattcagtttttaggtcttgaactgtttccttgaaagatttgttgatatcttgtatattttggtttgattttcttccatttctttaagggattttctcatatcctctttgaggccctctatcatttttcatgaagatgtttttatggtcattctcttctgctttatctgcactgtgatgttcaggtcttgctagtgtagggtccctagtctccagtggtgtcacattggtttttctgttgttgaatgtgcttttatattgtcttcctccatcctttcttccggtgggtgaagcaggagtctcttcctctcctggtggctatgggaccaaggttcccttttggtagatgcaagcagatccaatactctgatgtctgtccactttttgtggatggaggcaaaactggtactgagaccttggcactctctgggtgtgttggatccactgaattcaaatcccatgagcagtcccctggcctcaggtgtccccaagcaggccagcagaagccaatccggaaacagcccctatcctacatggtccagtggatggaggtaggactggtactggggacttggaaatctctgggtgtgttggatcctcgtccgggagagcacacctttcattcccagcactagggagatggtgacaggagtgatatggttgggaggagagaggagtataaggcaggaggagacaagtacttaatgcattctgaggttttgtggagagtaatacagtcaggatttgtggagagtattacagtctgaggatttatagagataggatctccctttcaatctaaggtagaggtaagagatagtggctggctattttgtacctctgatctttgactttaaccttgatatctgtctccaagtttttattattaagaacaattaaaatttgagctatacttcactacccatcagcatctaagtactgcttttcagtggctgggtgtgcaaagaaatgaagaaactatggccactatcacacagttacagtgtctgtctgtcaatgcaccaacaaccaatactttgaaaaaaatatcatcattttacatttatttatttacacacaccagtgtgtgtgtgtgtgtgtgtgtgtgtgtgtgtgtgtgtgttggggggatggagctcatgccatggtgtgcatgtggaaatcacaacttgagggagtgaaatctctctatcatgtggactccagagattgaactgaggttatcaggcttggcagcaaactctttggccttgtaaggacttccagaaatagcaaacatttgtcatacactctactctactcttcctcactgttctcaaagcatcaacaaagagccaaagcaactcttcccaccagttcagagacactgtaatgtggaccaagctccatgaaacattttccatgacattgtattttagtgtaacatggagttaaacttgggaaagcagcttaccatagtaaacaatccaccatgaaaatcaactaccttttgtctcttaaaataagcatcttatttctgaagagataaatagtacagtgacaagatgactctttgacttcctgggagattggtggaaatcactatctctgtatgtcactgacttgtggtggaggttacacattcaaacagataatgaagagaatgaaatagagaaaaaagggagtgtgaaagagggagggatgagggaggagggaagggagagagggaggtggagaaaggagagggagaaggagagggaggaagagagagaaagagagaggaatagttaaggagcaatttaataagctgattttatataacattggccatcagaaacaacatcttcaatatggaaatgagccagtgcagcaaaccaaactataatttatcatacaagaagaaagcagaaagggggggggatagtaattttcattctgatgcttctgtgactccagagccagttttcattaagaaaggtttttagttattcacaatattcattctccttgaaattaacaaactctttaatcctccaacttttagattttctctgttctagctgatcactttgtagttctcctctagaaaatctccaacgtatttctcctcgatggaaagcagaaaagggtggtgagccaagcagaactacaggagcaggaagccttcctgggttctggagcaagcctcagagtcttttccaggccttgaacaataactacctaaaacaatggatgtaattcagagcgcatttgaagcaactgcttcatacagtcaagcttctatagcccaaccatgaaagcaagtcacaatacataaccctcacattgtcacagagctgcagtgaataatgtagactgacagtcgaagtctctgacttaggtttagaaatagataattctatcaagaaaccataacattcaaggacaagaatgaaggcaaatactcatcctcatgccccttcaaattcatagcctctttttaagtgttatttcatgcaatactatttgtataaatatatatattcctagatataactagttgagtccttaaaattttgcttgtatgtgcatttttcagaggtggtcacccaaaagctgaacaaagatgacaccaaggaatatgccaagcttgttgaagaaatgcccatgaggccacagccgcacacagagaactacaggcaactgagtaatgcagggggcaggcatgcggacctccccagggagcagcccaccaattggctgtccagtagcagattttaatttttttatagcagaggtaatgaatgtaagaccatgaattttgggtaatcattagttatctgatcacaaaaataatgtgtataagacagaaatttctccaaatataataaaatacattttcagtttaatttttagaggaaactcaggtgattctcatagagaagagctgcagtttcttcttggttttcttatttaccttttgcctctgctatatttgatccttgggttttaatagaaaagaaaaaaaaatatttggtgcgtctttaaagagaaaagcaagaactgttcctacccagcaaggaggttctatctgtgatccaagctcagtctcactgaactccagagtgcttacttgacctgacttttcagaacatcctattcaaagatgaatttctaagaggagcggcactctttacaccagttgctttatgataactaaagcaggtaccaggaagttagactgtgattgttgcatctgctgtgctgaggtcaccagcctgtgcaataaaatagtcacccacctgccacatcatcctagagacaggaagagagagcttagctggagttagaaagctgtcctcaggttagttacctgggtgggaataaatctgccaaattttatgggccaatctatctctatcagatagattttatgtatcactactacataaaattgtaacctcctgtttccctcctagtctggtgcccaccaccctttattttctggtctttttactgccctgatttctgtttgttgagtgtctttcacagttgcttttgtgtttgctatcttttctacactttataagttcaacaaagacaggttttttgttttttttttttttttaaatcggcatcttccgcacatggtaggtaaatgtttgctgtataaatgaactgattatgtttgccttagtgagagtgtttagagtatggctgaaatgtatatttgaataaataaacaggattatcttaatagttgttctgtgtaaacacctgtaagaatacataactggcagtaagtgatgcatgaagataagattcaactatgcaattttaatgttactttagcagagaatattaaaataagagagacagaggctgtcacaatgctttaagttattttaggcatagaaaataaaaaatagtatttccaagcaaacagctatgtctgtaaattgtctttcatggtactttcctttgaaggcagagcccatggattatggggatgaagaacatacccaacaaaagaagttcgtatatctgtttattattagcaaaaggaatcacagtggtttgttaccttgttcaggttactttgaatgtgtgaagtgaaattttaggaaatttgtcagaaaaagaataaacatttttggttttctttattataatgaatccatgccaagattatgagcgcaaaatggaatatgaatattcattttttaaatcagaagttagtctctaggaaggaaaattgtgagttttgtcaaatttaataaaatggttctttttgatcaaaccatatgtgatataattcaaaagatattgtataatcacacttggcaataaaatgtatgataactataaggcagctttagtttttctatgggtttcaacaataaaacgtgaagtagtatttctgggaatcctctcagtagcacattataagcaggtgagagtcaaaccttgggcaactacttattttataggcaggtaaagcactgaaatgtttaaactgtaaatcattattaaagtcataaatacaattgtactattttgattttcaaagtaactttatcaatattacagattacttcagcttcctcatccagtctgatataccttgccagtatatgaggttggcctgagagaatgttagacaaatcatatcagctgggaagaggggaaaatgtgaggaacaaatgaggaggtaaaacaagaggtcaggtgttgggaaattctgtgtcaatgtcagaagagatagtacaaagaataaatgacaagatggagtctgggaggttgtaatgaacaggtccagagttgttagagtttatcaatgttggatgctgacttcatggtgcatgaatgggatggattaaaaatgcctgaaaaatttagacattggaattcaaaaagtctcttaaacattatattagttgaaagtggaagtataagaggtaaggctatcatgtgtatgtgtccatatttccctttttgtattgaaccatgctcatgataatgaactcatttaacaatagtagtattaatttatcactctgtcctcaaggagtaatcagcttgcattgggccagatctaccagttctgttgcactaaagatacagttccttccttccttccttccttccttccttccttccttccttccttccttctgtctttctttctttccttccttcctccctccctccttccccactcctcctcccaccctccttccctccctccctcccacccttccttcctcctttctccaaccctcccttcttttcctcccttccttccttccttccttccttccttccttccttccttccttcttttctttttttaaagaagatcaggaacatttattgtagagtaaagttaaggatgctcaatggctaaaaaaagacaatggccaaatggactactgtgccaatataagtgtgaggtgggttttataatatttataaaatctccagaacaacaagctttttctgaggtactttgtcttccagagactgacatacctgttggtttgattcttacagtggtttgcaatgatacaactttgttctttgtcagagagcctcctgttacacaatgctcttctatgatttaaggcacctggggttggatttagatattgatttttttatttcttttattcttctctcatacattacatcctgaccatggtttctcctccccctactccttccagtgccttttcccctgaacctcccctttcccccagatccactcctcctgtttcccttcattaaaaaaaacagcagaccttccaagatatcaaccaaatatggcctaacaagttacaataagacaaggcaaaaccctgtatcaaagttggacaagacaacccagtaggagggaaaggatcccaagtgcaggtgaaagagtcagagacacctgttcctgatcctattcttgggagtcccaagcgaacactaagctaaacagcaaccgtatcctagctcagacccatacagggttcatattatttattcagactctccgagcccctatgagctctgcttagttgattctgtgggccctgttttcccggtgtccataactcctctggcccctcttctttcctctcttctgctgggttgccccggctccacctagtgtttggtcgtaggtctctgcatttgctcccgtcagtttctgaataaagttcctctgatgatgggtgattcagctaggcacagatctatgagtatagcggagtatcattaggaatcatttcactgactttttttccccagttgtctttggttctatgctgcgtctctgggctgttttgcctctgggtcttggccctccaggaagtgtcaggcataggctcattctcatggtttgggcctaaagttggaccagtcattggttggctactcccacagttctgcaccaccattacaccagcacatcttgtaggctggacagattgtaggttgaaggttttgtgtctgggttgatgttccagtcccactgctaagagccttgcctggtttgaagatggccagtttggactctgtatcccccgttaagaggagacttcagtagggccactcttgtagattccagggagtttccactggactaggtcccccctcctggcatttaacaacactagtattaatttatcactttgctttcatagagtaatcagcttgcattgggctagacctaccaattctttttcaatgaatattcaggtttcaagacacacctacatggggaggcatttggattatagtatgtctttataaaatatccggattctgattaagggtctttgaaatcttatgtcatagagtttattgaaaatagactccacaagtcagaattcagattcagtagttcatggataaaattagtttggggactagaaagaaggttcactggttaagaggaactcttgcttctcttgtaggtggtttagatttgattccatcatctgtgtggggacacatagaacttctaactccaggtccaggacatctaatgctccatttttgttttcctgtatatgcatgttgtatgtaaatgcattcaggtacacacatatatacacaaaagaaaaataaataaaacttaaaaaatatctgtcagggctttccgccgaccgatccacaacgagcatcattcacccccaactccccgggcctgggcctacttggggtagacctgcccaggtagggaggaactccctgagtctggaaacaccctactcttccttcccatcccgtcccccccctcccgacctgacccctatggaggcctaactccttcagagtgaggagactaccaagagaggtaagaccatccagagctgcggacattgaattcttggcccacacatgccactgggtcacaagaggagatagagagaccccacctgcacccactggaagaagatattggaagaagacagaataagaactcactcaacaacagaaagaccaatatgacaccaccagaatctaaggactccactctagcaagatctgaaaagcccaacacagagcatgaagaagagatggatctcaaaaattatcttggcaagatgatagagacccttaaagaggaaacaaaaaaatccctcaaagaaatagaagaaaaagcaagaaaaaaattacacaaaacggaggaaaagacaaaccaaaaaattcaagaaataaacaaatctcttaaagaatctaaagaaacccaagataaaacaaccaaacaagtgaaggaagctcttgaaacagttcaaagcatgaaagttgaaatagacacaataaggaaaacacagaatgaggcaatgctggaaatggaaagactggataaactatcaggaactaaaggcatgagtataactaatagaatccaagagacagaagagagaatctcagctattgaagactggatggaagagggaatctcagctattcaagactcgctagagaatatacattcatcaaccaaagcaaaccttaagtccaacaaatccctaacaaaaaatatctaggaaatatgggacatcgtgaaaagaacaaacctaagaatattaggtatagaagaaggtgaagaaacactgctcaaaggtacagaaaacatattcaacaaaatcatagaacagagtttatgagcctttattaggggacgggattcttggctcggggtctctgctctgtaagcttatgctctctctctcaagatgcattaaagctttactgcagaaggatccgagtgttctgtgttgttcttgctggcgagacaattgcgcgggacaattccatgacaaaacagatttaaacaatacatatccacaaatccagcactacagaaggttctggaaggaaaactccaacccaaggaacataactacatgcacaaaaacacaggcaatagataatctaatattgccaaacacaaaaagaagcaggagggcaaaatccacacacaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagctcaaaccacacataaaaccacacacacttatagtaggagacttcaacaacccccttccaccactagcccggaccaccagacagaaacttaacaaagaaacaaaggatctgacagaagttatgacccaactgggtttaacagatatctatagaacattccatccaaacacaaaagaatataccttcttctcagcgccacatggaatcttctctaaaattaaccacatagatggcagcagagcaaacttccacagttacaaaagaattgaaataaccccctgcatcttatcagagcaccatgcattaaagctagaatttaacagcaatacgaattgtagaaaacctacacacttgtggaaaatgaataacacccaattgcattattcctgggttgaggaagaaataaaaaaagaaattaaaggcttcctagatagagaccttaaagaggaaacaaaaaaaaatcccttaaagaaatagaagaaaannnnnnnnnnttatgggacactctgaaagcagtgctaagaggaaagctcatagcactaagtgcctacatgaagaaactggagaaaagtcacattagagaattgacagaaccactgaaagctttagagcaaaaagaagcaaactcaccaaggaggagtagatgccaggaaaaatcaacctgagggctgaaatcaataaagcagaaactaggaaaacagtacaaagaatcaatgaaacaaagagttggttctttgagaagatcaacaagatagacaaacctctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacactgaggaaatccagagaatctttaggtcatactttgaaaacctgtattccacaaaattggaaaatctaaaggaaatggacagctttctggataaatatcacttaccaaaattaaatcaagatcagataaacagtttaaatctacctataacccctaatgagatagaagcagtcatcaaaagcccccaaccaaaaaaagcccagggccagatggcttcactgcagagtttgaattctaacagaaattcaaacaagagctaattccagtactcctcaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattggattccgacatgcagaagattgcagatagatccatacttgtcaccatgcacaaaacttaagtgcaaatggatgaaagatctcaccataaatccagccacactgcatcttctagacgagaagtggaattacccttgaacaaattggcacaggagattgcttcctgaactttacgccagtagcacagacattgaggtctgcaattcataaataggacctcttgaaactgagaagcttctgcaaggcaaaggacacagtcagcaagacaaaacgaccacccacagaaagggaaaaaatcttcaccgatcacacatctgacagaggactgatttccaaaatatataaggagctcaagaagctagcctccaaaacaccaaannnnnnnnnnnnnnnnnnnnnnnnnnnnnnnnnnnnnnnnnnnnnnnnnnnnnnnnnnnnnnnnnnnnnnnaggaatctgaaatggttgaaagacacttaagaaagtgctcaaaatccttggccatcagagaaatgcaactcaaaacaactctgagataccacctcacacctgtcagaatggctaaaataaaaaataccaatgacaatctatgctggagaggatgtggagaaaaaggaacactcctccattgctggtgagagtggcaacttgtaagaccactctgcaaatcagtatgacaagacaagaactcagagttgaaccccaaggcttctgattaatgcaacaactacacaaagtagggtaccaacttcctaatccaatatgagaatttaggtttacatctttctctggggtacgtatttccattcgttaaaaattaaaatgtatttaaaaattaagagtcaaatctcaggactgtttcttttttaaaaaattatttgttctttcgaagtttcatatttatacaatatgagttggtcatattcatccaccactccctccctctaactccctcgagtgctcactgactgtctttctcccaagttcaggccctcctttctgttagtattaatgatcctccagtcaattttttctgcccttgtgcacatgggtgtggagccattcagtgatacataggcaaatcaacaagtacaatgtcctcaaaggagactgactgtctcttccttgatacatcaaatgctaatagcttcttcaccagaggttcgtttcttgcccatccatgctgggaattcaactttcttgatcttgtctaaccacaccttctgtgaatccctgtgtgcaatagtcaagtcctattaagaagtcagcattttaccacagaaacagctgacctgaacaagggagagctcttggtccccagactgatagctgggaaacctgcatgggactgatccagaccccctgaatgtggctgtcagtgaggagaccttggaaatctatggggccccttgtagtggatcagtgcttatccctagcataggaatggactctgggagcccatcccacatggagagatactccctgagcctatacacagggggttggcctaggccctatcccaaaggatatgacagattttgaagacctcctatggaaggcctcaccctccctggaaagcagatagggtatgggataggtagggtttttagtggggggggcaggggaagtggggtgggatagggacctgggattaacatgtaaaataatcttctttctaattaaaaaaagtcagcattttaaagccctcttccccatctgcctccttatatgttctttctgcctcctgttctgcaatgtcccctgagccttgcatggggagaggttaacataggaggtccatccatagctgagcactcttagttatttagttactttgaccaattatgagtctctgcattaaccactacacattgcaaaaaggaagcttctcaaatccattttcaaagccacataaaactgtggatataagcataaatattcaggggacagtttgacagcagtaccatttagcataacaactgtaggttcctccactatggctctatggtactgtaaaccactcataggcttttgacctggtttacagtaccagatatgaaatccctcttgtgaagcatgcctcatattcaattagaaagcagtgggttgcccccttgagctgctattgtaccagtggttacatctttccaggcaggtcagtattgtaccacagtattgtctagcactggtgagaccactaatgtcttttcaccccaagcagcctacacagtactttctggcagtatgtaaaccaatcatcaggaaaagagtttcttgatcagttgaggttgatctttcgatgtagtgaacccaaagtgggtgctgttttaacaagaggtatttaccatgtagttttaatgggctggttaaactacaatgacaatgggctgtgctattttgggtgtatctggggcctccctaaccactaattcataggatggaatctattacttgacactgaggttttcatatactaaccaacgtcattaaaaataaaaatgcattaaaatatatatcaaatacaggactgttttttatgctttcaagttctaaaattatttttccttaaatatttaacaacatagaaatatttaaaaattactattttcccttcctatttctatctgcatagaataaacaatattaatagtttagtagaattttctattttccttttttcttttctagttttctaactatgtgtttgaatatatacatgcacatagatgtacatatatgtgagtacacttataacatctttctttttatattaatatactaatatactaatatatctattgcccttcaagttacataagtttactcagtctgttatatttcaggtcagtacagaaactaactcttccttattaagtactcacttgtctactgtactatattaactattattttattgacagctgtccaagtggcttccagttgctttgttattacaaacaatgctgctatgaacattcttttaaatgcaccatctcagttaggtttgtgattttgtttccttaggaaatacatttctgaaagtagaatgcctgaaagaggctatttgaagttttaatggaaattgccggatatttcccacaatgaagcattcaagctcccatcataagagttgtgagaccatcttgacctccacagctttgctagtgtttgttgctgctgaccataaagagaggaaggacttatttttgtttacttgtcttaggtatttgcaaaaagtatgagttaaaatgttatgtggttgtttcacttagtgtttttcttatatttctttttgttatttctgaccattttgatgataggatttattatttattagtcaatagattttgtgcagtaaaaatgagaacatatttattggttgactttatggcattttatactaagaagaattgtttttgttttgttatagaaaacaatgatagttattttcttcatgacttctatgcttctttcattgctaaaggatttttctacctttaattatattctaaaaatatatcatacaggttttagaaatacaccttaaagtatttttagtttgttattacatatttttagatttatgttcggattttctattttgtttcattcatttcctggctattcctatgccaatatttgattggtgaagtttaatactttaaatgtcatgttgtatgatattatcttacttcccctccccaataattgatattcatcacatattggtttttctacatgaacttcacagtgttccctgtttcttaggaattaaatatgggttcttactggggacaacttctatttttttggtgtacctttgctcttcttccctttcctcagtctttagtgtacactttgttctaaaacttccctgaggggtgaaaggctctctaaaatgtaagtcattgagttcttagtgtttcaacagtgaactgacaaagtatgctgatttttatctcactgatctgataggggttaaagagggaaaacatcaacgaagacaaggagtgaaataatggagaaggcacatatgatcatcactgctgtaaaactagtgaactgaggacaaaagagcagattggacgatcataggctgattggttcactgtgaaagtggcagcatggtggtgttgctcatctctaggcacttagatgctactgaggtcagagtttaagagtctgaatcatttcaaagagatgcagactcagctgcaataggttgtcaggggaaatagtgcagtaagtcacagttttgtcctcaactagactgtctaagagtatcctcaatcctttgtagcatttgcttcatctccccaatcagcaggagaacaatgcttctacagttgtagtttgaccttacatgttcaccaacattataaattcagctatcatgagaacaagggaaatgaattaatttttgggaaactgacagaaaaaattcttccatagttctacctgtacctgccagtgccatagacaatgtttccaggttcacatttacttgagtccacaagctatcctccaaacttccattaaggtctaccacagcccatctttttaaagctgatttatcttacacaatgagtttggtttacggcatacccacaactgtgtctgtgttctattttgtttgctagacaaccaagattttctgcaaatattttggcataaaaacaaattcaacccctaagtaacccagtatgagtagccacttaattagactgagtatacttggtaggttataagggtcaaagtgttcattctttttccttttttccttccttccttcctccatccttccttccttcctcttcccccaccaactctctcttttttttgtggttctggtgattaaactcagggccttgcccatgccaggaaagtactcttctagtgacataacccctagtccttcattgtgattgtaattggcttcaaagatgaagttcagatagataagaataaagtatatagaaagatcttcttttcaaaaagctaaaggtaagaaatttcagagaaaaccataatttaaacatgataaaaatcactgaaaaataaacaccaagtgccacaggcagttaaaaaggtcactcagttatttttgaatcaagacagagactcaaggttgtgatcagagatgcctgaagttcaaataagccaaaaggacagttgggatggattcctggacagtttaaaaacaaaatatattctaaggaaccagaggccatttagtgagactattaaagattgctcactgggggctgcctactcactcctatctttttttcttcagatttctcttagcaaacctcagtcagttttttcagctgcttagcataacagcctgtcacgaccacccttgaccagcaagaatgacgcaacacccaggaatcttctcacagttttactcaggaaacttgatttacagggagtggccccgaacccaggaaggaggggcttaatatatccaacaactaccaatcatctacgcccaggtggcacgctaggataggttgtcaccaaacagattagaatgatatgtggcctctctcctaataaggagttgtttatcactgagaggactcgccgttgggctggcggaaggcagaaaccggcgccatcttgtaggcgcggtactctgcagctcccaacaacagccaaatgcaggggctgtggaggagggagatgggaatgtgcatcatcctcacactgctctcgttagaaacactattcactcctggagtccattgcaatctgtgcagccatcttgccatatagagtcttgccttcctacttgtctgtgtctggattactgcactcctccccaagtctatcttatggaaacttttatggccaggtttctatggctgcagcttgtccccttaagaaatgagacttttactttacttttaggtatctacaacactgttggtctaaataggtatatgtgttgtgtttgaagatgattagacatgtggttgaccttaacagtctgagaagttcagagagaagtcatattcagcttagtaaaaattggaatagcacctttataagttcttaatttactgctctaatgggtatatgaaattgaagccttaacaaatagaattatatgatagcatgcaaagaaaggaaatgaacacgaagatgtttaatgttggaagattctacaagtattcatgtgaatcttagaaatcttcattttcctttgttaggcagataacatgggggcccagcagtgaatgcttaagggaagcacacttctcagcttagttgtccatgtgtgctaggacgtggctctgctgtgccgatgatgcagtggaagacatgcttttcttataatctggcattaagacattaatgcccttcctgaaacaagtggagcaggtcttgaggtcctgccctttcttatgctgtgtgtgatgagatgtaggcttattatcagagtaagcctaggagtggttccttccctcattcattcaacagggctccatttcaggaagcccatgtatctggcagaactctagaaggaatttctttctggatgacagttatgagtctcatgtttttgaccaactggctgtgagaactggcttgtctatgcctttggcctgctgtttagaaaatggaatgaaaagtagtacaaattttaagagtgaataattttcctactggatggagtagaccactgtatgaagtaaatttgacttcaatcttagctttatggcaaaccgtttttgtaatggtaagattaggaaagttataatcatcaatttataccattcttatttgagtgttcaatgacagcagctgtagtcatagagcctagatattgttctggtataaatccagtactgtccactggaaaagttgataggaatttagattttgagcataggctatatagactttatatgttaagaatcccttgaaaatatatgttttagtttcatttctgttgttttgataagatataccaacaaaaacaactgtgaagggggcaagggtttacttgacttatagttttgggttccagtctattattgaggggaagtcaaagcaggaacttagcaatggcttcaccaaagtcaagagcagaaggaaatgaagacataattgatgattgccctattcccatctagcttccttttgttctatataattcaggatcccatgcccaaggaatggtgctattgcacaatggattggtattattatcccaactaacaatcaagttaacatctcacagacgtgccacaggccaatttgatctaaataatctctcaattaaaccctggtcttaggtattaggtcttaggtcatcaggttagaatttaaaactagctatcacaatatttgaaggtttattctcccaaattgtgtattgagagtgcagttttctttaccatttatcactgagagtttatattaaatgtaggtatataatattcatattatataccaaatatcacccacacaaaaatgagttatgcagtcattaaaatgtgtatttttaaaaatcaagcttaatataatcaaacctgacagtctttcttcccccaatatttggttttctctgtattttaacactgtgaagaacatcttgtgccttataatgcgtgccattgaactttcgaggaacttgttgcatgcttatgtttaagaagtaccccaatatgtaaatgtaccacattttctttatccactctttagatgagggacatctaggttgtttccaggttctcactattatgaataatgctgctatgaacattgttgagcaagtgtccttgtggtgtgattgagcatcctttaggtggtatcactgggtcttgaggtagattgatttccagttttcagagaaaccgccatacttatttccaaagtggctgtacaagtttgcattcctaccagcagtggaggagtgcttccctgactccacatcctctccaacataagctgtcctcagtatttttgatcttagccattctgacaggtgcaagatgatatctcagagtcattttgacttgcattttcttgatgattaagaatgttgagcacttccttaaatgtctttttggccatttgagattcttctggtaagaattctctgtttagctctttaccccatttttaaattggattattctgtattttgatgtctagtttcttgagttcttcatatactttggagatcagccctctgtcagatgtggggttggtgaaaatctttccccattctgtaggctgtcattttgtcttatttaccatgtcctttgccttacagaagcctctcagtttcaggaggtcctatttattgattgctgctctcagtgttttatttagaaagtgttttcctgtgcctatgcgttcaaggctactttccactttttctcctatcaggttcaatgtaactagatttatgttgaggtccttgatccacctggacttgagttttgtgcatggcaatagatatggatctatttgaaatcttctgcacgttgacatccagttatgcttgcacaattcacatgatgaaatttccagacaaatggatggaactagaaaagccatcctgaatgaggtaatccagactgagaaagagaatcacggtgtgtactcactcataagtggatattagatgtacagcaaaggataaccatactataatccacagctcctgagaagctaggtaacaaggaagaccctaagagggatgcatggatttccccgagaagaggaattagatgagatctcctgttaaactaggggcaagggggtgcagtagaggggtggggagggtggatgacaacatgaggcaatgggatagtggagtgttagggagggatggattaagagagaaatggaagagatttcttgatggagagagccactatgtggttatggagaaacctggtgatagggaagttcccaagaatccacaaggatgaccccaattaagactcctagcattagtggagagggtacccaaactgtccttcctttgtaatcagattggcaaataccccaactgttatcatagagccttcatccagtgattgatgaaaccagatgctgagattcacaaccaagcacaggccaagctctgggaatccagtcgaagagagggaggagggaatatatgagtaagggaggtcaagaccatgttggagaatctacagagacagctgaaccaagctcgtggaaactcatgcattctcaactgatagtggtagagactccaggggaccaaactagaccctccatatgtggaagacagttgtgaagtttggactatccaagaggtccctgcagtaggaccaggatgtatatctggttcatgagctagcttgttagagcccattccctatgctctgtcttaatgcagtggggagggacttggtcctgccccaacttaatgtgccagactttgttgactcccaaatgggagtccttactcattgggaggaatggataaagatgggctgggaggagggagtggacagggtgggggaggaaggcagtaggagatgtgggagggagaactgtggttggaatgtagaatgaaattaaaataaataaatagataagtaacaaaatagaagtaccccaatcttcccctgaaggctgtaagaacattttccttctaaatatgagatccagtaggtggaatggggtttgtgtgtgtgtgtgtgtgtgtgtgtgtgtgtgtgtgtgtgtatagagaagtaaccactctatagaataaagcttagaaaatgtaaaggtctcagaactcctctagatttaggatgttttccacagaaaatacagacttctgcccatctttagatttttcattctacacacttagtcactaccaaatggaattttagtgcatgtcacctccctatagagaacttgttcacaaaatggatttgaatctatagttatctaagctcactgatgaagatcaactcaccacaaacactttggattgttgcagacatcagacatttatgacaaactattttttgattgtgtttaactgtgtggaaattagatggcctattttcacggggtttcttttgattttggcatttagctaatgaagttcttattttagcatcacttattttcaaatcaataataaatggctgcacatagttcaagtttctaatttttttctccaaagctgggttttctatttctataacctttgcaaattccaaagctgtaataagcctgcaggctgggctgctcttgtcgtcagactgtcctggagatggcagcagagtacgtggaagccagggcaccaaccataccgcataaacaagtggtgagattaatggtgctgtgcagttctgaggatggctctgaccaaatgcatcagactcttctgctctcaatgacagggcaggtaaatagggagctgatgtatgtattaatttgattttttaattacattggatagcttcccaaaagtcctgctcacactgcagcttttgtcctccacctgtggtcaggtccaagcctgtcttgcctgtgcttgcatgctgttcatatttcttttttggtgaaagtattgagagatcttcaaaacaaaaatcttgtgacccctttattttatgggtccatccacagcatttgctatcctttcttcatttttgtatagctatttctaatcttgtagcacactgcatttcaattcctctgggttgtcagatttttcgaatctataatgggatgattaactggcaaggcaacacacagcctaataacagattgcaaaggacatcatattagacattgtaaaagccctctttattccaaagtatacatccaataatgccccagaagacatgagtaatgagcattgttcccagaataacagggaccccattgctttggaatttgtgcagaaatgttattaaaatgaaaaagagagaagttgcttgtactgaattgcaactgttggtttcaatgctaaacttgtttgtcaagtgctgttgcctgggatcagtgaaagctcatataagaccaaaatatctcactagttggttgggtactataagaaattctactttggaggaagctaaaggaaagacttttttatttaaagatctgctgttattttttcaggtgaaatgctaactgtctcttgagagtatttttaagtaaaatgcacttttaagatgagggaaatagtgctgtggatggtgggtaaaggtttccagctcccatggaagatgggtaaatgtttccagcccctgtggatgatgggcaaatgtttccagcccccacttgacctgagggaaggggctgcttaccttactttttcaaataatagatcaataaaatgaattgataaaatcactggttttggttagattatccagctgggataatgcatttttttttgtaaatgagagattgttttttttaactgcaaatatacacaggagcattattgtgtacttgtataatatggaaattctgaaatgttgatttccattctgataattgtggagctaaacaccagctatttctgtctcttcacttgtgggaggcaacttaggctaagggaaaggagcattggaagaaagccttccaccctctcagcttcaaaatttgcttcttttaaaaatgcaattatttagccccaagaagctttgtggctgggtgaggaattctgtnnnnnnnnnnnnnnnnnnnnnnnnnnnnnngtgtaatttaattacatctattgtgatgtaatcacagatttataaacccaaacagaagggagaaatagatacacttgggcctgggcatattccgagtttaaaggatgttctattgaaagaaaaaaaaatacacattgcttttcgtttttcctgtcctttccccatggaaatggtttgagagagaaagtggaagagctgaatcccttccgcacttggaggttgtttgcttcagtttctgagagatgtgtagttaagaaagttttgtaatgaggaagtaaaatgacaaagtctgggagtgacagggaaagaaatattgaacatgcttgaaattaggagcagtttggaagtttgtgtctccctttagcatctcttggataggaactgcttcaggctcccatcacagtgataccaatactttcctgtaaagttgccaggcactaggtattcttttggattctatatgaatgttaacaaattcaatattcaaccacattcctttgtggaagattccgatatttgtctcataattttacaaaaaagaggaataaatgagttaaataattgagacaagtcaaaaagtaagtgaacttgaatgtggtgttcagagcctgttccaccaatgactgggaacctgcattgtggtctgaaggcctcaggtgtctctctatggacatttcagggctctcaaggctggaggaccagttcttgattgcagcatgaaggagaagcagcaactgcaatgtttggagtcagtatggactcagggcctcgtcatttttacctttctggaataaacatgaacctatggtgctcagtgaaaaggaaagccaccctgatggtgattgagattggattctctgctagccaggctggtgctagcctgcagctgaagaggccaggcacacatttggatctcttcactggataacaagaatgtcaagctaaatatgtccaaaattagactgttgaccttcccctcacaccactttccccctagagtcctttcaatattaagcctggtaactccatttcctacttgttaagccctcaaactcagattaatcccccaccctgaatctgggcattccttactgccctatggataatgcctagtataagttgccattttgtctgaattactgcagttgcttttggaatggtgtcccttctttctatgatgctctcaatacagcagccagcctgactctgttcatcctagaccctctccacaagagctcagtgccttcccattttcaagagagaaaggccactatctcaattgtgacctacaaacctgacaactagcgtctctggttttgtcactatcacttccagatttgtcactcagctcttacagtatcagtttccttgattctaccttcagggctgtaggaagccggttcctgcattatccattactataatggtgcctgaagacaccaagatgtgaattacttcacaggcgctgggtaatctccattcctttgatctctgcctatcccatggctcattttagcctgaggagctgaagccattcatagggtaacacgtcccaggcggctggtcagcctttataaagggatggtcttcttagtttagtgtctccgctctgggaagcttatgctctctaactctcaagatgcattaaagcttgtctgcagaaggatccgagtgtcccgtgtatgatttcttgctggcgagaaatacagagagcgcgcgcgcgggacatatggtgccgaaacccgggaagcttaacatctccagcaccgcggagaccccttggctacagggcggattcagaactgcaggatggtaaattcggagaggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctcaaaacctaaaaggccaaagaaaatggtaaaatggaaagatatcttaactgatctttggagaggcccggatcctattctcataagatccaggggagcgatattgtgttttctcacaggatgaagaaaatcctctgtgcatcccagaaagactcaacctgaagagtcccttcagaccttcaaaagtcggaactccaccctctacccccgaattgagagccgctattgttatccagattaactcctgcccttggcggagagattgtcactgcttaaggggtgggggtgaaattgtttgatgcagccgcttgcggattgctgttacttttgactggcatgtaagctccagggctcaaaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataatggtgcctgaagacaccaagatgtgaattacttcacaggcgctgggtaatctccattcctttgatctctgcctatcccgtggctcattttagcctgaggagctgaagccattcgtagggtaacacgtcccaggcggctggtcagcctttataaagggatggtcttcttagtttagtgtctccgctctgggaagcttatgctctctaactctcaagatgcattaaagcttgtctgcagaaggatccgagtgtcctgcgtatgatttcttgccggccgagaaatacagagcatgcgcgggacacagggcctttgatttcaccatctcttctacatgatgtgctcttcattcagctttctacatgattaactactttcttctcatctcaacttcatgttttagctaagggattccctgatcatcctatctcaatgttaataacttcacatctttaaccattcagatcccctttctcacttcatgttttcccctggaacacattgatgtctactatcttatttatttaccatatttaccatattatccatatttattattgattcccagttcttcataaaagccaggagtttgtttatttggccttatctatgattgctcgctgttgctgaggaaggttctcaggtggtgtaggttgtcctttaactttttgcacacacagggtagctgagtttgatgttaaacttctgatcttcctgcctccacctctcaagtgctggggttacaggtgtttatcactatgctcattttgcaaaaattatttcaatcactcctttgtctttgacacagggtctggggcattgatatatactctataagtgtatcctgagtgagtggattcatagaaataaaaagatttgatatgccttgcaccttaatgatatgacaaaatttatttatacttatttgtaaaattgcaaagatgttcagtgtacaatggaaattaactttgtcatctaacatgacaagcagcctgatcaatgaacaaaccagcgggatagtctgccaagtaaatctctaagtcatttaaaatacataaaataaaaagttttattgtttgatttatcagattcatgtacacagattaccccctctcgtgtgtgtgtgtgtgtgtgtgtgtgtgtgtgtgtaagtgttggtgcctgcagagtccagaatcggatgtcagatttcctgtaactggagttataggtgactgtgagcatgtcataggtactgggatatgtatgtcctgatagtagatctgaggaaccctttggtggaatcaagagaattttgccaactttgcctcttctttccatataattctacatattaataatacaaaacttatcactttccttatttgtgacacccactagcatctggatttacaaagtactttttaaacccagacaaatacgaggacgtggcttaagtgactttataatccacttaacttctgtccagtcatctaataaaaaaataaatagtatatttaatcaactaagtgtcaaaaccattttaaataactggaagatggagagaatatgaaagatggagagacagaagaggacctcagatttctgctatttctattattcttaaaatcacagtttcttgaatatttaattcttgtgataaaaacacgatgctgtttgaatctggtttttgtcagagagtagaataagaatgacccaacagtatgaagcctctgtactatttctccaagtcatactcattaaggtctgaagaccgtacacatattgggctccttctaggataatgtctcccctactgttataattcctccaatgaaacccatctgtgagcttctacaggctgctcatgacatgcatttaaattgtttgttgtgttccagaaacctcttcttcctgcaaacaagtggtgacctctgtgctctctgttcatccaagggacagacactgtgcatcatcccaggcaggcagccaaatggtggccacatcctgttctatccaaaaacacacattttcattacaccaagataattagaaaaagtagcatagaggaatatgagtaattccatcagtaattacagcaattacacccttaattgccataccacctccggtgtcacattatatgtatatgtgttggcattttacagagaaaacactcatatgttttagagtccagaatcggatgtcagatttcctgtaactggagttataggtgactgtgagcatgtcataggtactgggatatgtatgtcctgatagtagatctgaggaaccctttggtggaatcaagagaattttgccaactttgcctcttctttccatataattctacatattaataatacaaaacttatcactttccttatttgtgacacccactagcatctggatttacaaagtactttttaaacccagacaaatacgaggacgtggcttaagtgactttataatccacttaacttctgtccagtcatctaataaaaaaataaatagtatatttaatcaactaagtgtcaaaaccattttaaataactggaagatggagagaatatgaaagatggagagacagaagaggacctcagatttctgctatttctattattcttaaaatcacagtttcttgaatatttaattcttgtgataaaaacacgatgctgtttgaatctggtttttgtcagagagtagaataagaatgacccaacagtatgaagcctctgtactatttctccaagtcatactcattaaggtctgaagaccgtacacatattgggctccttctaggataatgtctcccctactgttataattcctccaatgaaacccatctgtgagcttctacaggctgctcatgacatgcatttaaattgtttgttgtgttccagaaacctcttcttcctgcaaacaagtggtgacctctgtgctctctgttcatccaagggacagacactgtgcatcatcccaggcaggcagccaaatggtggccacatcctgttctatccaaaaacacacattttcattacaccaagataattagaaaaagtagcatagaggaatatgagtaattccatcagtaattacagcaattacacccttaattgccataccacctccggtgtcacattatatgtatatgtgttggcattttacagagaaaacactcatatgttttatgtttaaaatgtacctggtttgtcaggttcctctctaggataaagacaatttaagtagaatggtttcattaccgtgatcaaaactaaatgcattatactgttattgttattgttattgttattattgagctttttcaagatacgatttctgtgattttgagaaatgtgggaacaaaagccaaggcactaaaaaaataccatttcagagagggaggagctgagtagtggttgagtatgggaggaacttggcaaggggaggggctgtgaaagggaggagctgtgcaggggggatgtgtgactggggcattgggagtgggacttggagtggacgaaccagccatgggaggagctgtgcatttggaaggagctgggaaaaaagaataaaatttgtgtatagtaaaatccacagctctttacaggtccatgagtttggacaaaagtgtccaaatttcaacaagctagagaagattttcaccattacccagagtatttgtggtcctatctcattctgagtttactctgtggttccagtgaacatctttgcctttgctccttaaccattctattttttgtgaaatatgaacttaagcacttctctactttttaaattgagtcaactttcagtcatcaagctcactgacagtgagatatgagctgcttgccacatttgatcattgtgaaattgtctcccagcctatgtctcacttcttaattgtttttgtctaacaaattttgctttgatggagttactattttataattacttctattttgtttcttaggaaattgttcttgtttcaactaatgaaaaattcattttaagattctaaaattgtaagagttttagctgcaagcacatgtatgtatacaattcatctcaaatcagttttatgcagtggctgaaggaggagccaatcttctttcatgtgtttgaagttacgccaaagctatttattggcaagtctttcttcattgttttaccctgtacttgtttttaaaatatacccactatagacatatgggcctacttttgaatactagactattccaattatttatttgtgcattgttattccaatagtacatgttcttgacttttgatacatactaaatggtactgattttcaacttattgcctccatgtttttctagtatatgcagataatcatttgtgtgctgaccttatataatttatttatgaattctagtagcttttctgtagactacctatgatttttaatttcataattagtaaccctacaaataaaaacagattgattttttctttctaatcttgatgcctttgcctttcagttccaattattgatgttaacaaaaaaaaaattgaactcaaattcctcaaggaaaataactgttgatcacttaattcccttgctattcctttaaaagggacttctagaacatgcttgatttgcatgtactatatagactctctttgggaatattttactgaaagaaaaattctttgggttgtgaaaatatagaggggagaattctgttgctgctcttctggattcattacctcaggaacatgagtgagaatatgttctgtgaatagtcagggattgaaacacacaattactctgatttttagtttttggatttcacaatttcacagttttacaagacttgtacttcatagcttttcatatccccaggctcgactatctttctacacgttttattaaccacattcaatacagaagaaaatttgatagaaaatactgaaattcattagcaataccccatgaaatagataagagtgtgtgttgtgtgtgttatacctccttttgccagattcagtgagatatctaagtccatctaagtgatgacacttccataccccagaaaaggaaattaaaagtataattgaagccatgtgttttgcttgtgtgctgaggtgcccatggtgtgtgtgtggtggcgggggcaggggtatcttcagatgctctttcattatcctaggcaaacaagcactaggtttctgtgcatgcacttgcacaggctgaattaaggcgcattgtttgcccagttaatacatgttttggaggcaccattatttgcttataaagctctgaaatccctttgtagatccatcatcttggaatgacagctttgaggggtggaggctgatggagtgcttcttctggcaactgtgtttgcactgccatgggcacagcccacagggagggggcttctgatgggtaatgcttctttctgtcaccccagtgatggcacagccagaaatagcagacagcatgtgaagagacgatgatagagtatgaaggtggcacagactgacaattacccagaatatggcaggccttctcccagagtaactgagaactggctgaaccatcacttacagagaggcacagagtggggatctttttatgtcatgcttgagaaactctcctcatattctgcagagaaggaaactatacttattttcttccctgtcttgctcacagtttccaaaggaataaaaaacaagagggagctgttgctttttcccaaattatggacatctggctattcctttctcctaatttccaaaggttgtcatgttgcaatctgggatggtgcttcttcacatttggaagcctgacaggtgtatttaacgttttcctatgtcaagaggtgtgacctcagaatagcactgcatgtattccatgcagataaattatttctagatgatacggtttgagtgtgagatgatcagcataggttcaaggatttgaccatttggtcctgagctggtggcactgttcgggagacttgtggatcctttaccagatgtagccttgctgcaggaagtgggtcagtgggggcagggtttgagttttgatcctgctttctgtcatctttctgcttcctgattgtagacactatgtggctcacacatctgctgtcatgccttccctaccacaatggaccatatcccctcaaactgtgagttcaaataagccctttccccttaagttgctttctgctgggcattgaaccataccaagcaaggaaataatacatgagctaatcaagaacttggttccacacagctaaatgtcatcttgacattagttaagagtattaagtgtcttgcatgatggacatgatactgcaaatcatgaagtgcttggaggaaatcactcttagtgcttagttgatgtatattctatgacaggcaaaccattgtgttgtacaaacacttctcctaatctaatttcctttaattatggctctaggggaatctcaagaatatgaaggcataaaaggacagaaggagtttgaacagattaagaacagatagtttattctgcattgttttgaagaaaatatgcctgatttttgtacttttttcagacatagtgtgttggagaataagtcataagatcaaaagttttgatagggctagggagatggctcagtcagtaaagtgtttgccacacaaacatgaggacctgagtgtgatctctaccaccacagtaaagataggtgtggtaccacagttgtaatctcacacagttggtgaggcagaaaaagggtaatccctcaggcttgctggttagctagcctaggctacttagtgagttccaaatccaatggagagaactagtctcaaaaactaaggtctggaagatgacaccagaggttgacctctggcttgtgcagaaacacacacacacacacacacacacacacacacacacacacatgcatgcatgcatgcatgcatgcatgcatgcatgcattttgaaaagtgtgacacaccaagtgagtgcataagtgaatttctctataacataaaactcactgctcagaagcacaaagcaaggtctcttcagtgcctgccacaagcctattcccttgaagctgtcctgctgctttcataaagctaaattgtggcatggtcaatgggcagacagaagcgttgtgggtctccattgtggacatattccatctgaagaccattaagaatcttctccgccagccctgtgtcattctcattaaacactaatcaaaaggccgggctcatcctttgctgtgtcccctattccttttaatgcacctgcaaataaaacgaaacagacttaatggactgaggcctcggccgattctcacagctcagctgcatggtcacaagttgcttctcctggtaatttacaaggtttcctgctgtatgataaaacacaggtgctcggcctgtcatccagagtgatgatttattagctttagtggtaccacagacctcaggcaccaggcactaaatcaagagaatatatactgaaataatgtgttttccaatggcgacccatggagactctttagctgttcatgccctctacccaccatggttggttttaccatttctcctcattatttcaaagcccacaggattcacttcctgtcttaatttctcacctgccaggatagcctcggcactagctttattgctatagatttctagttgatcccttgaaccactgaagacttccagttaatgagtaagagaaggggaacctcaggggctttgtaggcctcagggactcaggatctgtcttctaatttccctttggtatagttaccagacaacaaaaactcacattagccttttaaataactatgctttgaggttaaatatgtctggacattcatttacaatttgtatactaggtttgtcatcatggaaatttgttaagagggcctgtcttcctgttttcatgacagtgactatcaatcaaactgacttcttcttgattatcagagagccctatgaacatagtagagaaatctttaattactattaaatacctgccaaacatggaacaggaaaaaaatatcacccagtcaatcaaaatggaggcatggtgtggattcttaatttttaatggaggaaagcagagctgcaaagggagtctttggtaagaaagtaaacacagggaggaaactactccaaagcctggaaagatctgaagagtagaggtctgacaggaaagtcagtgatctctgcattctcaagtaaggcgatgagaaagcagacaccagttacatccactgggtaaagaataggaggcttagcatttctctcattatcagtgccagacctcagcctccaggtgtgaacctcacagcccgtctttgcctcctgacacaggtcatgcaagtttcacactcttatgaagaaggtaggaagaaccaaaactgtgaattggtgagtttgccttgtgggtatctgtacatgacatgtgcaaaacagattccccacatcaggggacatggaggtgggccaattctgggacatgtcagcactaaagtgaaacagctggtggggaagattgaggagatggtgcccactgggcatgctcagaattaatggctgttcagttacttaaagaggaaaacacatgattttgcaacggaatcttcaaaatatccaacacttgatgagttaccactatgaccctttggaagggcagccacagcagcaggacacaagctctgtgtcccaagacttgcagtgtgaaaggtctggggacccagatgtggctgtgcagccaggtcagttagcagggcctgtgagtttgagagccctgctttcaacatgctgatatttcttcatctgaaccagtctataccagttctttctgctattccttaattcataatgttgcagaaagttttttcgttgttgttgtttttccttttaaactttgcagttgagaaataagggaaaaaattgggaccttaaaattttaattcattaatttttaaatgtcagggcctcatgtagcttagactggccttaaagccccatgtagttatggatgacttcatacttctaattctgggattacaggcatgtggcatcatgtcagtttatgtagtgttaaagactaaaccaggagcttgtgcatactaggctagtgctccaccaattaaagtatgatccctactctaaggatgtggtagttcaagatcaataaacatggaggccttgcgtcttccaactcctgtgtgtccagccaaaggcaacctgcacactgcgttcctagccagctccatcacagatcttctcagctagatgggactatttcctggtgaattttggattgtagtttatgtctgctgaaatgccagagaagtcaccatcacagattttcctaaataatgggagtcattgtatttaatgtgtttgggaaggaaataaagtgagaatggaacttggatagctatgcaactaatttctaaggtagcatactaaaaataattgtggactagataagggagtggatgaattcaatggaatttgcctaaattatacaacaaaagaacatccatcagtgtgtctaccattcatttatctcctgctagtcatctatcacaatcatcaccaccacaatttaccttgttattcttggttgtttgaaatgaaaaaaaaatgtaaggaatgtctctccttctgttttttgactatatagtatatattgggcagaataagtgtgatttatataacctaattctcacaggcagattatttattttccatttttattagtaaatttacagtgtttaatattaaagaattgttcaatgttttcgctaagatacaccctaggggaagtgaatgcacatttcaaactgtaattcatattgccagatcattgtgaaattttatactaatttatactttaatacaacatttatgagtctttacttctttccatttatagcaaatattgatgaagcagttttccaaatttgttgattgcaaagtaaataatttatctcattgtttagtttaaatcctcccagctactggtgagaccaaactctgttgtatgtgaatgacacatatcttataagcatttttatcttagcctttgcttcttaattgtggtgtttacagtgtgctatttttcttatttacttattaaaacattctgtatagtcctttgtgatttgtgctgcatttttaatttttgcttgcatacatgggcatgctcaccagtgtgtttaagagtacagccagcttcaagtgtcattcctaaggaaattccacctagtttctcattgccacttgggatcacccattatgctacactggccaggcaggtggctccagggatcttcccatccccatgagcccagcagtgttttatgtggctgcacacttgtgtgtcaactactctgttgatggagtaatcttctcagcccatttgcattcttgaaagtctgcttttcaactctggttttgttatattatgttgcatttttctgtgtagaattttggattttcactattatttttttcgtatggattttgtatcatgtttagaaaaaaacttccttccaaattggactaggcatgactgcgggtatctatttgtccttatatattttcatgatttacatttaattcttcattcctaatttatgtttaaagacttccagggaaaggctggtagaatgcttaatagcacagcctgagaaaacttcagggttcaatgtcaagtgggttacgttgttggaatcaatatcagcttctcctggttttctgcataaagaggcacaaatatgccatccattttgccatgagtatcaatctgttttcttgcccactttgccctctccatgcatctttgcaaagcccctggccctacactgcctgtccagggctttggccatctgttttcctttgctttgtgatagccacacctccctgttgttggcctgcctgcttgatttctgaccctgtatttgtctgactctccaggagctgtgaacctctgtctttcttatgtctgcttaattcctacctcactgcttctctctgccctttgattatcagtccttctggatgcctatgtgagtaactgcctgctctcctgtctgccagattgccctcttttcttctgcctgcctttctgtaggttgctcacctgcctgtttcttgtctatctgcttggctgtctatctacctgtctgctggttgccatgctgtctgtctacttgtctgtttgtgtgcctgttggattatcacagttcaacttcagtgaattttttgcctttcctctttaagtttcttaccactgaaccctctatgttattattattattgttattgttgttgttttgtatacatgatctcagcctcctaatcttagtttcttttaaggtttaagatttttaagattttagttcatgaccacgtgagacgtctttgacaattgaggcatatgtgttccttatgtcccttggacttgctttggaattctggcatcctctgaagtgaattgtccagttctagcagttttctgtttagttcaaagaacagcctgtcattgaggtgatacagaaggtagagtctagtcatgttgtgtatgtggcagggccagggttatagctttggattgctagcttcatgatggatcctagaagagaaccacttagaagccaaggatgtcagctcaagtagatccagctgaatcccacatgttgatcttgaaggtgagaggtcatatcctttttagttgctcctctccagggcaaggcagcaactcacatctatctacttgttggacagaactgaaaagcactctgacaaaggtgtacagattaagtttgtaggcagaacagcaggaccagagctatttagagccgtatttcatcaatttagtgtcttagacaagtatttgttccagatttacttcaattacttcagatggcaataagaaaaactgtatctgtctcatatgaaagcaaatgtaagaacactgtaaatcatttaggtaacatatgcaaaatgcttaaaacagataaatgcaataagtactcattaaatggtatttattatcttcattgtatttattgtcttttatctttgcctggataaccaggcaaagaactgtgtaccaccaattttaacagtggagggttttgtcacttagtctctatggaaatggtatcttgtggtatttaccttaatataggtaagcagcgttttatcaatagctacctagatgatgctttccaagattttataaaaggcctgcttcctgaaagctcagcaaagctggccaagggtgtgtaaagtttaggttacatgaggtgcttctggcatttaagctgattaaaattgctttgatgcatttgactgcagacctagagtggatattcaatgaacagatccaaggactgagactcatagaacagatgtggagacattcaggagcacaaaggttctattagtagctctaccacccctattgtttctttttcttctatccccattaattgagaaaatggaagagtgcatatcccaatgcaaaacaagctcttacaaggaggtgttcaagttagacaccctttccacatgactttagggcttagccagaatagacatagttaggatgtgcaataacagattattgtatcttcttatatttcacctttatgattgttaattttggatgttttacactattaagttttaatcctcttttagactaaaaggggaattgtagggagacactgtagccccacctcctagtagcctggacaggtgtgccgtgacacgcccgtgaaggcgtggtgaggggaagtctaaggtgacgtgggaacggtttttaagggactgcacacacgtgaatagcccttctttctggcttctctctctggcctggctgccttgctgcccctggcacactttggcttgcatttgggctggtgtttatctgaataaagaaaactaagccttacggaatacggatcgatctcatcacttacctttaagggaatagaagatattttattctgaagccaaatactagtgaaatgactaaggaacatggatctagcttgcatattccagcatggcatgattttcataattgcaggtccaaaaagtcacaaattaaggaccttttctagtaataggcagaactatcaagtaggtggattaccccaaagtgggagaaatacctgctatagacctcagatgatggcattcatagcctatgggttgggagaagatggagatctttttgtacatcccaaaagggtttacctaatgatcatgaggagggatgccaggtcaggtatagaggtggaaaatgaataactaggaatggggtaaaagacaatgaatggctatgaacagggcaaagacagtgaatggctaggaacagggcaaagacagtgaatgactaggaacagggcatagacaatgcaagataatttggctcagaacctgcaatatttcagctcttctaatctgccatacagccttgtagagtatttaacccagatttggatttgttttgggtatgggttctgttcgttcacagacatattcagtatgctcctagagttcacatggatgagaggatgtgtacaaatatatcaaaagacaaatatttccctgtgctttgctatgggagaagacgttgaaggcagagagaaaattttgtaaggaatggggacatttaaaggagcagttcattaggctataaaggctttgggggcaagaattgtgatcattcttgttatatttatcattacttagggctaaggcagaagggcccagcacaaacaaaaaagaagtgatatgctctgaattttaactgaggaaagagtctagtctactcccattatggatcacatacaggggagcaagttgacataaaggccagcctccaggaagactccctgctgaggctgtcaaaggccttaaaagaccaggcaggaaatgagtcccttagaatgaggagcctggcatgcaaaatgctaaccagctgtctggcaaagagccaagggaggccagaggcagcaggtggctggaatgatctagaaggttctgttatgtggcatgaggtgtatgaggtgaaactttcccttttgtcctgtgaatatataattaaatttgaagtcactcactattagtgtttttggagttgggatttgggagtagttataggggtaggcagatgaagtacagagcccagccatgggtagagaggattggagcagagattgcccaatggtggtgccaggtcataccttgatgcccatagtagagtatagagtaagtagagaagaagccagtctgctgactaggttgtaaactaccatctggtccacaggtaggaagaggagaggggaggctttgtaatggtgtcagttggattgggctttggcagctatcatggtggatactggtttacccaagcaccaagtatcctgaatgagtggtcagagacaggtgcctggtgtctttaactttgtgagggatcgtgtcagagaacaggcccattctaactgtaccagttaggtgggtgaagtagcttggggcttctgggaaggaacaattctcctcctattagatggaaataacaacatattgagcctgaattgctgctggcagtgcccttacagctccaggaaaaccaatcttccacagaggccagatggagcaacagaaaaagcctgcttgctattctgctgagagtgagaaacacgggtcctagaaaactctgtggggtgagaagcaaagcaggtgagaaagctgtaggtgtgtacagtgagcagccagggcttctccaccaatggtcccctctacaaccactggtcaggtctacacagtgggaagaaactcaagtaaactcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaagttattttaagtttatgcttatattgagtattggtttttaattttgtaatttagaatatgtaggggaaataaactgtaatggtaacgattccattttctcaatggtgacatagtttgctgtgtcttaacaaactgctgtatcggtaggcaagtgtgagtttgactgcattgtcttcatctggtacttccttctgtaacaaggtattgtgggaagagcttcagagaaaatggcctacagcttttgatcctcagctttggtgatgctattgatagcttccagagctcaattcttctattgtaccttagaaattttttctgttaaatggcatagaatcatgttcatcttctaaacacccctggaatcttgacgtaaagcagtgctttgtcctaaagcattgtcagagaaaaaggactgagaaaggttgatgagggcctgggtgaagagtggtcacactagtgctcaggtcaaattctgtctggagttttgcattctacattcctaagatttatactaatttttaaaactaatcatgttcaagtgggtttatactttcttcttacaccttgttctttgttttaatcgagtgtttttttgcctagctggactgtaagttctctgaagagaggaacttttttttctggatgtcattttttggaagagtcatgggaaaatagctaaacaagtgtcttcagtataactgacttaagtgctcagtgctattacatatgcataggaaggctctgctttccattctgggaagttttgttttgtttactatatttttaacattacgaattggattaaatgcttattggaaatgatttcatagataatagttgtatgaagtcagagtatttaaaattcaataatgcagtctttctgcttagtaaactgtaagataaatgaagactttgaaaacaacactataaactacatatctcttgttaacaagaggctaatgagctgcttgatctctctgaacaggttttgatttttagtaaaggacaaaataaactaaaataaaatttcccccatgcttaatatgaatatacttaattttattaggcgctagtatcacaatgatactaaggttcaaagaatccaaggtggaagctgtcaattcagcaaaatggagatgaggggatggaaacagcaatacaaacaataacaataaaaacaacaagaaaaaaacctcaagtctccagtggcaatttgatggaaataaaactattagaaataaatggctccacacatcttacagtgcatcgtcttttcttgctctaggctaatagtagccctaagtgagagagtgtataaatgactataactgtgagacatgtatggggaagacacacaccccttttctctttttagtttttatgacagggtctcgaatagtacagaatggctcagatttgctgattagctgaggaagaccttgaacttctcctcttgcttctacctcctgagtgctggattacaggcatgcacctccatggttggatttttcattatgtagtgccggggatcagatccagggcaccctgcactccaggtaagcactctatctgtggaactgcatcctgagccccaaggcatatgtcttgatgggaaatatgaaacagagacgataatgagatttaaccaggaaggattgggacgcaactcctcttcatattggcatgaaagcagacacatagcagtgggagggcctcataaacataattcactgaaatgggagggtgataaaaggccttttttgttgccttttgcagagataaattacccccaaagctgcagaaatcttcctctccaatttcagattgaatgtgcctgtataataaacatttctgtaacattcggcttctttaacctagacagctcaattaggacggcgcgataaaatacagcttctatgtacttcgtgaatgcttaatgcagctgagagcttgttagcatgaattcacagaaaactggtcttgtcaagtgcttaaggaagttgaatggacattgagtttaacaaacatgcatgtacgtatgcatctgtatagatatttatgtttagggaaattctgattctgcctattattcacattattatttttttttgtgaaaaatctctagttcgttttccttgctatttactggaaaatgatgggcacacttgggaaatttctcacatgtcggagcagatatccagaagccggacactattttattttaaaggtttatttatttttattatagatatatgaatgtcttgcctgcatgtatgtatgcttattgcatatgtgcctggtgcccttgtaggtctgaaaagggaactggaactggagttacagatgatatgctgccatgtatgttctgggaaccaaacccaggtccaccaaagagcagcaaatgctcttaactgctgaannnnnnnnnnnccagccccaggaactcttctttagaatagtgtgtgttccttgccaaagcaatgggtttcggaataacgctttttgtttgggttatcatgtgcttcaaccatgttcactccatgttgtcctctcctgctcctgacacctctcccccagctagtgccttcttcatgtccagaagtcctacatgctagagaaaacaagccatgctttttctttggggggctgacttatttcatacattttgttgtttttaaacagctggacaatactctattgtgtatgtgtactactttttccttctctatttttgtgttgatggactctgattccataacttcaaatcaagaactctgaagactcataaagagtatgtgagctgaaagcagaaagaacaagggagagtgctagcttagattgctggactgatttgtacagttcttttctttggaaaatacattaaggtttccacaggactggctcggggagaacctcagatgaatgcagggtctgcacactgcaccatgcacagggcacagtccacagtcactccctgtccttactgacaccgaagcttcttccagaccacagttcgagcctcccttaggtacagtagtgacaccataaatattgtcatcgttatatgccaaatagggcttctgtgagtgtcctgagatcttggccactagcctcagttttgtctattccattttggatatacttcaatttttactccacccaaggagtgctgtcttagttatggttacaatttttatgatgaaacaccatgaccaagagcaagttgaggaggaaagggtttgtttatcttatgcttccatgtcattgttcattattgaaggaagtcaggacaggaactcaaacagggcaggaacctggatacaggagctgatgcagagtccatggaggggagctgcttcctggtttgttcctcgaggcttgctcagcctgctttcttatagaacccagcactaccagcccagggatggccccaactacaatactgggtcctcccttatcaatcactagtttaaaaatggcctactgtcctacctacagtcagatctgatagatcattttcttaattgaggttccctcctctacagtgacactagctttgtgtcaaggtgacataaaattagtcaccacaagtgcagacttcctacttacaggacagagacattcttgctgttcatctattcatgacctcaacttctgtgacaaatggtattctcttgtgtcccaattttttacctccctttgcctgctctctgtctcccactctgtgtcttctatcaggtatggctctgcctccatgagtctctctcctagactccactttgttccatttttacttctcttatgacacaccaatttctgcttatattattgttatttatatgcctgtctactcttcctgattcgattctctgttatttttggaactagtgctgtttattccactctcatttttccatttacacagagcatatttacaaacaggccctgccttcctagaacaatgaagagtttcatatatagcctcgcctcaccgaataaaaacagaaatttccagaacgtcaaaaggtagaaatttatttttaatgttacatgatatttttggaagtgggtgtttcagatgagctgaatgtactttttctttcccggatttgtgtctccatgaggaagagtaggcacgaggaagtacctgtgctttccacatttcccaggcttgtttacacaccttcagattcaccagacaagtggggctgcagggaattcctcgtttacacttctaattgtttccttaaatgtgacagtaaaaattcattcagaaaacggcagcagatttaggagataaaataaggcctcagacggctgttagtaatacaaataacttgaaatgtttttgccaactgcatgtcagctgcaattaacaatacgatgtttattttggtgtggatggataccctgtgtaggcagtctctcctggtacatcaacagttcttttgtaatgtctttctaattgaaacagcctgtctgggagaaggcagatgggagtgcaagaaatgtccacggcacaaccatttcagcacatagaactcacagacgtcagcttatcctggcctgcaagccagggatggctcttggtggaggggagtgatactcacccaggagcttgggttacacagataccatacactaactttttgccagattgtagcaattttggcatttcctgattcatatgcagtgctatcgtgggaagattttgaacaaatattgatttgtgagaatcagatgagtgtcatgattcccattttagtattcccttttctcactcagtataattttttttctaccctcatgagaagaagtaaataaggtatgggaatgttggcacactcagaggaagtctgactaatgttttcttctgtaccacagaatgtgttctggtgtgtgtcaaaattgcttgggtgctctggtgcctgcttcctgatgagactgagcttgtactcagtttcgataataaaaagacagcatttacaggcttatggaggcgggtttaaaagctagtcatttagtccaatatttatctgccacctttctcttgccctgctgctgtaattctaaccatgaactgtgactgagctggcaacatgcctcttatgatgaggtatggattaatgataatgattttgtctcttttagggatcttcttgttcatatactcaatcgtcccaaaggctttgttatttccataaacattgagtggtgctatataggaaatattatataacaagcacattttaatttgtctggcatttatggaaactagtgccaccatggaaatggaccacattacctccatgtcaaagactcctagggatactgcttctatcagttagtaagggtgctggctacagataacataaaccccaatacagtgtttgaatttactttgttactctttgtgtgtagaacaaaaactctgtctggaagttgatagttgcatcttcaggcttctgttagagtccaggctggaagaggaaatggatagaggacagtgagtatggtaggaagtcactttttccctgtattctcagcttatactttattaaccacatagataccctgctgccctagaatctggggaattatcacacaaagtcagactccatttcatctcatctctctctctctctctctctctctctctctctctctctctctctctctgtgtgtgtgtgtgtgtgtgtgtatgtgtgtgtgtgtgtgnnnnnnnnnnnnnnnnnnnnnnnnnnnnnnnnntgtctctccctctttctctgtggggtgtgtggctctttatatgcgagtacccaagaatgtgcatgtggaggtcagaggttaacctagtacatcttctcagtccactttgtttttgaagcagggtctcttgctttgtgtttacctttttggctagatcagctgtccatccatccagagatctggagatacacttgagagtctccacctctgactatgtaagaatatgagttctggaggttgagcctagatcttcatgcttgtacagcaagcccacagtacccgatcttgattctgcactgaatggagaggatggcaaccattccatgcacacacgattttgaaatgagtcgggtaagtgattgctggtgactgtttttctgtgcttcagaaccttcagtctgttgggccaagtattttcagagagcaggctggggtggggaaattagcaaagagctagaaactggagcagattgatattgatagttcgcaggtcagttagcttggaagtcaaggaaacagaaagacttatggtgactggaatgtgactccttccttattttcatcttttcttcttttttatgcactttagtattatccttgatatggtggaccttataaaaatcaccccatcgcctgtgacctgccctgtgaagacagacactcggagaagatagatagcattcagataatacatgctcaaaccaactcctgcagaggagaggagaggaaaggaagagacggtatagggggaaaccaaacaaaaaccttgaaatggcagcaaataaaatgtgcccagggactgatgctcataaacctttgcctggttttattttcaatgtttattatttcactaagatttcagggtccttgacatattaagctttggattcctaagtggtgcccaagggaaatggtgtgtatgtgattaatgactttaagtaagagtcattcattggtatcacaacagattttatgttctgacaattacgtaaattaaaccagtaaagccatcaaaactcaccaatatttatctgaatttgtcatgaacattacagggtcatcagcatacatcgtaatttatactgcctatgattagaagtaattttctccatttcctctgaggatctgataaccactgctaatggtgtcaatgcaaaagtaaacagcagaggatccgagctccacctccactatgtagcttcaaaagatgggcttgtgtgtgtagaatatttttatgaattaaaaataaagaaatgtcaactgctaatttttatttaaattaagatgttttgatagtacacagaatatatttttataggtgaattatacatttgtgtttgataaaaatcataattagaatgaatatagcaaatatttagaatggttggagcgtcttaaataaaccatggctgtaatcttgacacataaggtttagtttattgtcatttaaattaccagttttgtccctataatgttgaaataataattgagacagggctgccatcttacaggtctatgtgtgaaataaaaaagtctaggtgctagagggatgactcagtggttaataatgcatgttgctcttgtagggaactcaaattcagttcttagaacccacattggacagttcacagcctcctgtaattccagctctaagggacctgacactgtcgaacctctgtggtcatctgtactcacatgtatgtgcctcttcccaaaatacatataattaaaataaaatataccaaaatatgcctaggtgtatgtgctggctaatttttgtgtcaacttggtataagctgcttttttaaaatagctaattcccgcttttatcccacagaaattttataatgtttgattataggtaggtaccccagacctcactaggagactatggatcataattcaaaactatacatattctataaaacaagtgcccctaatatctcagatataagttgacaagatagccttcagttactgtcaactcagtggacaaaaagctactgaaattttagtaagtcaggagaaaactcctccaggatagctgtgagctaaatctttgttcatgttgtcaaaggaagtagatgcagttccagagtgccattcccttcatgatctgtgagtggtgcccactgtcctgtggatgtactggcagcatgccaataccagtatcataagaaaagtcagcaactgatgaaatgtacatgggaggtgttgtcagcatccaagaaggaatctatgagttagccattaacaccacctcaggaagcttatgaaaggaagcaaaaggtgatagttaaataagatacaaagtcagactctggttgtccatgagatagaatgatatatatatatgtgtgtgcagcatatatatatatatgctcagagtcccagtgggggtctgtatgaatacattcaaacacttgaaactttagcctccttggcttatccccaagtcttctttccttttttttaatttaatttttgttttattaactttgttttcatttattttatataccgaccacagtttcccctccctcctctcctcctgtcaccccccatctatccccctccccatctactacttaattcagaaagaggaagacctcccatgggcttgaacaaagcctggcacatcaagttgaggcaggactgagttcttccctctgcatcaaggctaggcagtatagtccagcatggggaaaacattcttaaaagttagctaagctccagggacaggtcctgatcttaccagtaggagtcctacaaagagaccaaactactcaactgtctgcatgacaatacacatgcagagggcctaggtcagtcccaggcaggttcccgaactctttgttcagagtccatgaactcccagagctcaggtcagctgtctttgtgagttcctccatcatgaccttgatagccctggctcatgcagttatagtgaggcacaattaattaatgtgtactgcaaaggagtcagagcaagtttgatgaacagatgttttaataggagagtactaacgagacggagtcagtccccttcaaccaggcaaaccatggaacagagagagccgcctgcatgcaaccgtcatatttaaggtcttgctatgtcactctgaccacgccctagtgttcgtggtctgcgttacctgtgccagcccctacatacagtccctcatctcttttcttcagcactgctcctagagcttggcccaggaagaagaaatcttaatcaaggaaatgcttccctaggattggccagtagcaaatctgtagggcactttcttgattgatgattagtgtgggagcatcaagctcattgtgagtggtgccacttcttggcaggcagttcaggatagtgtaagaaaggctgaaaaagctttgaggagcacgctagtaaccagtgattctccatgaaactgcttctgcatcagttcctgttcacagggcccccctgcctttagttttttcccccgactttcctggatatttcccaaggtgaaataaactttttttttcctcatggcgttttatcatagcaatagaaacctaactaagacagtagattaagctatggcaacaacttggctagcaaacttgtgttgtttgctagtgcctgccctgcccctgaacccttcacgctatgcagagaaccttcatgatttgtgaatctggtctgaagagtgaggttcttcttacagagaatgagtggaacaccatgagaacagtgagtgccaagaatgcacatccagaagccaccctaggtgcccagagaacagttacatctctaccccaggacacttgccctacaagtggagatcaaccatgggcacagttattgagtgagtatatggtggggaaacaggagagtgagagaggcagaaaggttcatgtcctgggtagagagatagatctgaagagtcaagggcagtgaggaactggctgacatagatggtttggttgccacccagggccatggtggtatccaggactgggctgctgccaagggccacacctggatctgtggcccagctgctgctggggtctgtgttgatgtgcgactgagggctgtgcaggggtctgtattctgggccaactcctgaggctatgttggtgtttgaaagtcatgctgccacgggggccatatagatctggatggcctgttctgccacctggggccatggtgaagtctggacctgaactgtgtgtggccaagggctatgtctgggtccatggccctaccacaaccagggtctacattgatgtctatggcttctgttaccactgaagcctgagcagacactcggggtctgggttgccatctgtgtactggttggcatttgagtgccatgttcccactgcagccatgttgatctaggtgacctgctatcccagctgggatcatgatgacatcctggccttggctactgccagggaccatgtctgggttgatgtttctattgcagcctgagtctgtgttgatgtctagggctggtgttgccactaaaggccatcacctgtggccaggttgatgtccaagggccatgtcattgctggggctatacagacttgagtgacatgtgctgccacttgaggccatgccattatttgggctgagctgtggccagaaccatgtctaggtcggtggcccaggcacagtctctgtcagttgatgtcagtgactcctgttaccactgaagacagtgaggaaggggctgcagagtttgtcctgctcctcactgactacagcactagggaaaacttgacctgactcccaccaacagcagcacatgggagattgcttgcttgggaagcatagtagagctgacccaattgttggggatgtctgtgagccaccagaagctttgagagtgggagatctagccccattatctgttaccacagtgtcgatggcatgggtaaaaggagagatacctccctcaccaccccccaccaacttcaggtgggaaagccggtcccagagacttgagagtgggagtgctgaccttacccttcatgggctgcagcacttgggaaagcaggctctgcaccttgcctgggtagaactaaccctgttggcatggtcatatgtgagtcagtcctgagagcatgagagcaggagggctgatcctgccccccacctcatctgccatgtggtggcatgggcaaaggaaagatgccctcctttgcctcttgaggcaggcaaaaaagctggcttcaggggcataagcacaggagagcttcctgtacctcatgtgcagggcaaaacagtagagctggtcctggtgatgtgagtgtgggggacatgaatctgaggacccgtgagcaggagaactggccttgctccttgctgcctgctatattgtgtgagttggtcagggcagtattggagagcttgccctggtggtgatgaagagggaaagctggaagactgacaacccaactaccacccaggtccagaaccagagctatgagttggctcaccccagcatccacttgatgaactgctggagcatgtgaaggggctggatccaaaactacaggatctcatgatacaaggcaacaacagaagatccaggacgagcccttgtgagggactaatactgagggtatagccaaagccagaccaatgactcagtgcaacgaacacttacaaggtaagatatatggactaaagggtatgtttactgtgtaactcactatgtcacattacagcttccacaccaagactttttgtttgttttggttttggttgtttttaatttaaaatttattttattttggtgaggggaaggttgcaagggtagatagaaggcagatatgaagggatgaaagatgaatggggttgggattcatgatgtgaaatccacaaagaatcaataaaaaagttaaaagaatgaacatccaaataactttgcttgaaggatcataaacgtgtaaagcaactgactgcttatttgctatgctcaaccatattttgaggctgaaaagttagagattttttttctcttttgaacttcacctcatagatgaataaatattaatttctaattagtgatatgccaggaactttatggacaattcccatcatgacttacgataggatgtattttagagataacaatgactcatctaaaggaagtaagaaggtagggttagcatcaggtccaggctcctccaaccctttgcttccaaggaccttcaggattagccttggagatgaccttttagttctcaagcaacctccttgataattacatctttgtgtgcttgagaccttgggctattcaagatactttacatgcacagatgtttttaagtgaacatctctttttgtatgcctgaatagtgtggttataatgtatgtgtttgatctctgggggctatagtttgagcaactgaagttagtctaccatagacttcagcagaaatggaaatttgcaggaaccttggatttcttttctttttttcaaagcccctatttttgtggtagagttacttacattttactttttgcatttttacagattctacaactttgtagctatcccaaagatgagatctgctaatgaatatcccagccattcattttttcaatatttctagtagttccaaagtaatctattaatgtgtattaaattcatgccaatttgaaatatctcgactctacttttctggggggaatatggcctgagagagtgtttgatactagtggtagttgcccatgccaaccatcaagggatgatagtcagtgaaggaagaaaacaagatctttctcttcaatttctgtttgaagagagattgtagaccaggttgcagcagaaaatctcccaatacaagatataaggttcatgaggttgaggatgcagttattgatggtcagaaggttgaggctggtagaaatttgaagcaataatctagaaaaaagaattagatggagacagagatctagaattctatgcaaggattttcatgggtctttgggtgaatactaagtttttcttcatagcgtgactctactatgttgggcagtgagaaactagtagaaagttctaagtggcagaatctgtagagctcacatggggtgtaatagtttttgttttgaaaaatgaccgtggagagactttttctaacagtcaaaggattcatcttaaaaacagatattaaaatgatcagattgatataaaacatcttgagaaaataggacctaatgttctttaaaaagaataaaaaaatccagattctggactacgtagtaatcatgtctggcattcagtaaaaattaccagccacatgaagaaccattggagaaaagaaaattgtagaaactagcttgaggtagtagagaaaattaagtttcaaacaagaatgctaaagaaaccactagagctccttccaagaatttaagggaaacagacatttaagattatgagaaacagaagctagaaaataacaggtctggggctaaaaatataatacaaaaaataaagatttaagaaaatcctgggtggcctgaagtgacaagacagtgtagaattagaaatcacagaatgtacatgtaaccaagaagcaaataaaatattatggttttaatgagaatgacccttataggtgcatatatttgaatatttggttcccagttggtggaactgtttgggaaggattagaaggtgtggccttcttgaggaggtatttcactgagggtgggctttgaattttaaaatgctcatgtcattcccagttagtgttcagtctgcctcatggttgttgtctcaagaaatgagctctaaattactgcttcagtgcaatgccagcctgcctgcctgcagccatggtccctgtcatgatgatcatacactgtatccctctgaagctgtaagctccaataaagtcttccttatataagtggttttggtagtggtgttttgtcacagcaatggaaaagcaactaagacaaatattaattcagccagaaaaaaagaaccttagtggttttgtgagacaaaaataagagtataaaatattgaatgctattttagtaagtagacagtaaagaaagtatagccaaaatcattctatattacatgacagctataaaactatataacggagaaattcagtgagcatgaagtaaggttttttttgtcattattccctaaacaatatatgtaatttaaaaagggggggagaaataatacttttaaggaacattacaatcacatttctggaaagcctgataaaagaaaaatcttataaacatccacatcaggtcatcatgtgaggaaataaacctagaaatgacctgtcacttctcatcagaagcagaacaggccagaaatgtatggaggatcatttctaaaccattgaaaggagactcaagtctctcagtgtagaaatttctatcacaaagtatatttaattaatttatgttaataactatttttctgcttgtatgttggtgtgctgtatgcatgcctggtgcccacacaggagacagaaggtgtcagatcctctggaactagagctgcatacagttgtgagcagccatgtggatgctgggaattgaacctgtgttctctggaagaacagtcagtgttcttaactgttgagtcatctctccagccccacaaaatatttctgtcaactatagagacaaatgagaattatttttaaagcactagatggaatttatgttataacaagtaggtcagcaatacaaaaatagcagaaatatattctttttaaaacaaacacaattttattgcttttaaattattctaaaagatagctctaggttaaaggaaaacatataacaacaattaaattaggtgcagatgagcaggctctgagggcatgagagcaggagagctgaccagaacccctccaactcatcttccatttggtgtcatgggtgagggaaagatgccctccacgtttgccacctgcagcaggagggagatttggccttatgggcatgacagtgggagagctggacctgcccctcaccaactgcaacactccagaaagcgggccctgaaccctgcctgggaaaaaagtagagctgttcctgttcgtgtgtgtgccagtgacctggcccacagggtgtgagagcagaactggcccttgttgcctgctatattgggtgaaccaactgaggcagtgctggggagctcaccttggcggtgatgatgagggagagcttacaggctgaccaacccatataccacccagtcccagaacaaggactgtgttcaccttatctatgaactactcgagcatgtgaaggagcttgacaatcttcagcgaaaaagaatggaagagaaagggaaggagagaaggagaggagaaaagaaagggaaggaagatgaacaagagaactcacaacagatgatataaaaacttaaatacttcccaacaacgtcaaaaccaaagaaaagattagtaatgaaaaaccaatatcatatgggataagcgtacatagcaaggtcgtaaatttaaaaccaatgataataatgacagtttttcaccaactggtgtatagtcaagtaaaatcatttatcagaaaggagagaaaacaaaatatccatagctgaagaatatatataatttatatatatataggcttacttactaaaaatacccatgcttcttgcaatggtcaagaatgcttcacattatgtattactcacctagaaaatacatgatcaagatatatgcacaaaagtatatattttataactataaaatcacacacacacacacacacacacatatatatataacttataaagacttattagtcttacaggatcattatcaaaatcctcccatatggtcatttgaaggctgtcaatttgtacagtaggtagtggtaggtcagagaaaggaaagcaggaagccagagcaacagtggatggatgccctgcctgcagctgaagacctgaaacctcctcagagaggtcccagtgtgcttgcatacaaaggcataggaagctggatcctggtgtcactggtgtggaagcagcagaaattgtgcctgctgaagaagaaccaagcttgtacatgtggatggacttcctcctgtctttgcttcttgtgtcttgtgaacccagaagcctgtccaatggtgccatttgctattgctaggggagccccacattcagtctactgaccagatacatcaccttcccagacattccataagtatgcttctttaatgttctaggcctctcaatcaagttgactgggcaaatggattcaccaatcacccccacacttctgtacaagattccttgtcactggaccttacttctcactctttgaccacactcttttgagtattgcactatggtttttgagtgtgctttattctttgtcaggctataacttctctggcagacaaagccttattttaagccttaagttttagcttggaaatcatatcacagaaagaacttctcactccacatctgtagaccaggctggcatcaaactcacagagatctgcctgcctctgcctcccgagtgctctcactccacttctatctcatcttaatttctaatttacttgtttattgtctctgcagtagaatgtgagtaccattgcactaaggactaagccattgggctgcttcaataaaacgccttagattgtgtgacttaaaacaaatagaaatgtgttggactggagagatgccttagaggttaagagcactggctgctcttacagaggttctcagttcaattaccagcaaccacatggtggcttacagccatctgtaatgagatctggtgccctcttctggtatacagacatacattcaggcagaacactgtgtgcataataaataaatcttaaaaaagagaatagaatcctattaatcatcatggagatgacaagttcttagatcaaagtagagtgtggtgagttgtaacttttagctcacccaccagaagcatcttcccttgttcttacatgaaggtagggaaaaattcatgtggacctctttttgtttgtttgatgtgggatcttatgtagcccaggctggcctcaaactttctatgtagccatgtataacattgaacttctgatcctcctgcttccaccatctggagtgcttggctaataagcatatggtgttaaggatcatactcagagattcttgcatgctagacattctatcaatgagtgataacttcaaccttggacctctttctctttttttttgaactactatttgaatttaataactaatgtcttctgggagtaacagtaccagctggatccctttctaaggccaaccacattcacaagggaccttacctcatgggctatctacccaagggccccatctcttaataccatcatcttattggctttgaattcaacatatgaattctggagagattcaagcattcttgccatagcaaagatcttctttgtattgtgtatcattatatgcccaaatataacataatgtatgttgtggaatattttgcttgcactatgacactcctgagactgacaataaagtttggtttgaatcagagggtggagctagctactagctgaccaaaattaaccatagaggttttggaggagagaggacatatagggagatacaggaagtagtagggtggggcttaaaaagattctcaacccctttggatgtagggaggagagagaaaggagttcactggtcatttctctgctgcttctctgatcatccaggttcttagcctgatatctgactcctgagttgttttatttatttatttatttattatttatttatgtatttttttcgagacagggtttctctgtattgttttggaggctgttctggcactctctctctagaccaggctggcctcaaactcacagagatccacttgtgtctgcctcccgagggctgggattagaggtgtgtgccaccaatgcccggcctgactcctgagtttttattgataaggaataattagacaaatggttcaaatgtgcttcatgtattaagtgctattaaataattgcttgagtgtgtgaatagttattgccacccattggaattcctgaaaactagctgttttggtaactgtattgccacagtgacaaaccaaacaacacataataaccactgagtgaatttcttagtgaagcagtgtatgaataaatgaaataatattcaagtcagtgcaatgagtgtaactccaggctcactctctctaacaattaatattatatcccttgggctggagagatggctttacagttcagagcatttcattgaaattccagaggacccacattaagtttccagtactgccaccaggcagctcacaacctcctgtgactacaatgccagggaatcctgtgtttttgacctccacaggcacctacctgcattcccagtgcccacacatacaaacagagcatacatccacacataatttcaaataaataaaacaatttaaaaagattatatcatcacaaaatgtgaataatcttttatgttgggaaataaaatcatcaaacacgtaaataattaaaaccatcatgttacagattaaactattaaagaagaatgtcctaattttgagctctttgaaagcacagaaagcatataccctatctatctatctatctatctatctatctatctatctatctctgtattcattttgtgccatgcagctgtacagggcatcttcctcctcagctctgagtaaagagaagacacaactattattataatcccaaccttagaagtatttctttctgaagccagttgcctttgagcagtcaggaaggaagtattgacatatattttcttgcttctcactttgtggttgtcatataggcaatatggtccttccatagacgggacgcactgcaaaggacacttcattctcatgtgctgatacatgatggggataaagcatttaaaattaaatgactgttatgaaggaaaagattccaaattaagaaccacacaggagcagaggtggtgccctgtgagacagtgtcccatgatgatttgtactttatgacgtatgttgtgatgactgtaaccaatgcttcttggttttatataacagggtagcagaatctcatctgtgagaatttatattatatctccctcaggggcacagttttgttccccccaaaactaaattcaggtgtaccctgggatttctttgacttaaaaggctcaaatatgtttaaaatttttacagcttctgctaggatcttgggattttctgagatgtaactctcagaatcctggctcctttgtctgagagtttttcccctggtaggagaagagtacctagtcccagactgccctgcagcaactggttggttctgaggattaatgataacgtttaagaaatatagggatctgtggatgaaatatgctttttttgcttcaaaatgttagtgactgaggtgacactttctggttataaaaattgaatcaaacatgtttaccacaatagtgcttcccttgtgatgtgcctgtactagtactatttcatccagccagcatatatgcatgtgcttattagagcatctcacagatacaactgagtgaacatgatactgttgaaatttaataattaagtaacagttaatttaccaagtccttcaccatagtattggctgaaaagaccctcctcccaaaattcttcggtgtatttagcaatagaaacatagtaacagaccaaaatcttctagataatttaatcctctcataacattcttgaaggaaattctatccttccttcgcatttaaaaaatttggtttaaagagcaatctacacaattacggcctgaagtgtaagggtgtgtcttgcccatgtgtttcaattcattgctgttggtttgttggtgttttaggcatgagttccatgcttatttcaccacataaggctgcactttacatcctgaaaataaggtattcttgttgttgttgctgtttagcaaagtgtcatgcatacaaacagggaggttatggggaccattcaggaattaagttcagctggtgactcactcaacttttatatctaattaatgtatacaagtattcatattttgtatgtttctttttagttagaaagaacccagacactctttgaagtatgaaatatttggataggattgacttgtatgtggaccagaatcagtttcttgatggacattttggtcattaggtaaggaaagttatatgtgactaattatctaaaacttgaatacatgcaaacaagaaaatagttacctaagaaagaagttagctctttaatgagaataaactaaaatagaaaagtctcatttcagtcctccattcacagttcttttgtcttaggtgttgggttagcaaaatctgttttggtttgcttttaataaaatgtttgtactgaatctgtaaaatagtttagatcattaaacagcattatcatacttaataatatcatcaaatatttattgagtttcttgcataattcttggcatatgggaaccattaaacaaatgattcttgaattcattaaattatattgaataaaattaatttttaatatagaaaggtagcacctaggtgtattcagagcaaagtgcaaacaatgcatctaaaattaaaatctaccacatctgtctgtttgttctagaccacattctcctcagaaattgtaatttggacccaaatgttgccctttttattctttagtattaaataaaaaaacaaaaaatttgtagcccaggtgggtctggaactcactgcgtagcttaggctgtccttaaatacatggcactccatctgcttcaaccttgcctgagccatcatgctgggctttgttcagtctctctaggtcaacttaacttacacctatgtagaatgaagccaggagcttgagttggggcctcctaggtacatggccacagtgccagcctcagtacatggaggaagttggacaagggaaaagagcctttacatttgacatacagtctcttccatggaatctctctaaatgtcattctataggatccaaaatcctggaccattgcatagtgtggtgtgtaaacataggtgggccaccatgtagtgtggaggggtaagcattggtgggccattgcatggtgtgtggaggggtaagggtaggggagcaaatcaattggatacattttatctgctctaggtttctcctactgagacagcatatacattaactccatttaggcacaaatggctaaaatcgtattttcccgcatatcttgaaatctatttgaccttttaccctctccagttaaatcacattggcacaccaaggaaataatgttctcttcagcagattttgggcaacattctctgaagttgctatcagtagtatattttggtcatggaatcaaggtgaagacaaagaaatcagatttgtaatattaggaaaaattggagaggccaggaggaagaatgaggaagcgatgggggtgacagtgaccttcttcataatgtagcaaatagtggcttgctacttcataactcctgatgaatatcgcatgtaaatattagggatttttcattgtccgtggtgatttagaaataaaatgcatttgagtcaaggagcagagagtattaggataatttaatttgaaacatgaatggaatctatgtgagataaaatcaatgaagaaaaaaaagcacaaagcgggaggggtggaacagcccttgaaagcctgactccctctttattccacctcaaaagctccccacttaagataaagcacactcgattactttgttgataagctttccaattttcctaagtattatgtcataaaattctaaatcgcatcatttaaaatttgagcctgttttctcaagtctcgaatgattatgcagctagtggaattttgccatctctcatctaaattctttaagcccttctcttccctgggaagagggatttaagctatgctccgaagctgtactctggctgcaatatcttcttcatttctgatcacatcctcttcagagttttccacacgagacaaggagaaacttcacataagtgctgatttgctgggggagagaacaaaagaggatttttctgtaatgtcttggagaaggagctgggtttctctgaattcagctgtgataagcaccaaggtagtttgtgcaggtagttaatgacagataactgcctcagtcgagagagccaggcagcatgtgggtttttctattctctttcaagtcaagtctctagctagaaaagaggggctttattagcatcgggtgcttcttcaaggacagcaaaagcagcttgggaagcgggtgcccatgctcagaaggggttctggattgtggctttgctccctgagtgtttttgaacacacatgaagaatgtattcatctaccttcagttcaataattaatgtcgctgtccctctagctactgttagaataacaaatacaggcgactccagactctaaagggatttcattgaagaagttttatctcctgtgtattttggccttggagagtgtatcattataaatttcatagtggcatgaagcaaagaaactctcttaatttatgagaaagtttgtgacctccataaaaaaggaaatggtggacagttgggcagaatatcttactgaattttcatttatcattagagagaaaggcttggaaatagtgattcttacagtgctgtggaacaagctccaactgtatgacagactctcagcactcagtgtggggaatcattttcctttcaaaactctggttattctatgcagagcttgttctgctgagagacagagagttaagtctaaaatatcacctgaatttgaaggaaactgaaattggagcaatttcacgagagaagaatacatacagacacagatgcagatacacacacacacacacacacacacacacacacagagagagagagagagagggagagagagacagagacagagacagagacatagagatacacatgaacacacacacacagatgcacacatgcataagagtgcatataaacacggtaccattttcttggggtttagagaacatcctgtgtggctgccatcatagaggggagtgttgtagtttgtttgttttttccatcttgaattctgtttctctttaggatcaacagtggctgttccttaatcaacttctccagtgtaattccactgtgcataaagtatgaaatggatatctcaatcacatgtgaaatacacacatttataccacccatcattttttgcccacttatcaaattcagttttaatcatcatttacatttgctttgtcattatgcttgtaacttgagctttaatctatccatcttcttcattgatgtacaaggtaggagttttctaatggccatttttcccctcacattgataaaagtgtcatcttgctttgggacacaggatgtgtcttggaaagagcagcaactagaattgaaacaagcaaaagccatgtatgatccagctgtggagtgctgattctgaggccaagacagtttcagaattcaccaattatgattctgaagtacatagtacttgaatgaatagtagcccttcaattacagcttactggattgtgacttttgtacacttaattaatattataagttgtattatattcacttattttctgcatatattgataaatctacttttttactcatataatttattcaaagtagcatctttctcaccataacacctgacacaatatacataaaataaatagtatctaatatcaccaaagaaataaagacattgatgtattgttcccagatagatttttaaaatagcagtttctaaacatcaattatgtggtgcagaaaacaaaatcaagaatttaaatttaaaaaacatcttctaaatggagacaaatgagccaacaattgtcttctctaaattcaagtaaattatgtttcaaatttccattacatctgtgttgggccatgtgggaagacatttatgaaatctagctctgttggaattgggagatagcatccttttacatatgtggtgtctatttgcaaacgaagtgaaaagttacccaaatgccagctagtgtgacactgatacctaaagttttgttgaagctcatatcgtcctttttatatcttgataagaaaaactcaaaaccagttttaaatcaaaagtctctatttttgactccaaacaagttaataaacatggtgtcaagaaaccatagtgtagccgggcaatggtgttgcatgcctttaataccagcactcagggggcttagacaggctgatatctgtgagttcaaggacaccctggtctacaaagggaattctaggacatccagggaggtacatggagaaacaatattttgaaaaaatccaaaccagaccaaacaagacaaaactcatagttcaatattaatagagcacaattgtcacgacatcagtgacatttaagatttaaatagtaaaagagacaaacattgtcccctggagaaggggaaagggtcacgatcccctgagcaaattgagagcatgggaagaggggggagggatctacgagaatgaaaagggaagaagaggaggatacagaggtcatgagggagcagaaaggttgagtcaggtgtagattagaagaaaggatatgtgataggtagggttttagttggggctgtggtaggggaggaagggagggagaagggaattgggattctcatgtaattcaatcttgtttctaattttaaaaaatgataaaaagatttaaataggcctcttttgttgttaactaacatttggtacaaataatgagatggattattttgcttgtctgtttgtatgggattatgtattcactaaagatacagcatttactaattaaatataagctagatgaactgatttgattatcagagtggaatcattcactctgcattactgactatatgaagatatttatacatgctgtgataaagagggacagtttaaagatgtaacaacttcagtaatattttagtggcatgtgctctgtcttaatttttttaaatcaaacttgatttctaaaatctttctacccatatcctgacaattcacttctacttatttttgctcttgaactttaaagatataatttcctctcaaactgtatttactgtctctgagacctgcttattatgtcctcaccagcatcagtatcaaaatggagattgaccatcttgtgtttaatttgttcattttcagttggaatgaatactactgctgctttcaagtcccttatgccttactcggctattctctctcattttcacataaactggtggtcaagctctgaaatagatcctgttatgtggaaagagtcaattaattcacactttgatcttgtaagataggttctatccttggacaggatttatgggcatgactgtaaagtccctcactccagcccaagtggaatcctcctatccagccaatggctagacatgtggaaatctttgctgatttttctatatatggctttccagcctagcagccctcaattccatagtgtaaattatcctttttaaaatctaaactgtgttggaggtatttcagaaattgcttctccatatagacagtgtttaattgaggatggagctgcaagccacacatgtttgccttgattgtcatcaggtggctaaaaagcaggccgtaaatgatttttttcatctaaatgcccataaaagctattggctgtctctgctacaataccagctggttggaataaagccattctttacagagttatcaatcatatatatactataatttcacccattcattctgtgtagcaatctcattgaagtttcctcttacaaattagccaaaacatccacttttagcctctcctctgaagtatttggtgtataccaccacagcttccaatttatatagattatgttctgaaagctgatttttaagtcataaattccccaccaacaaggaaatcttttttactctgcttcttcctgtttattgttataacttactggaatacacacactgcttggtatagagcagatattaagtaaaattgtgcaatacataactaaatgtaatgcttatattgaaaagccaactgcaatgtatataagtgcattcaaagttctgttgtacaagggagagctcatggaccccagacggatagctgggaaaccagcataggactgacccagaccccctgaaggtgggtgtcagtgaggaggcctctgaaatctatggggcctcaatcagcatacgaatggactttgggagcccactcctagactcactcacagggagagcctagagcctgctccgaatgatatgacagactttgaagattcccccatggaaggcctcaccctccctggggagcagaaaggggatgggatnnnnnnnnnnnnnnnnnnnnnnnnnnnnnnnnnnnnnnnnnnnnnnnnnnnnnnnnnnnnnnnnnnnnnnnnnnnnnnnnnnatgtaaaataagcttgtttctaatttaaattaaaaaaatacaaagaaaaaaataaaacataaaaaagttccagtgtggagtagagctctctacaaagtcagacatagggaatatactgcatgagaatggattctttgtctgttttccccacactgagaggataaaacttctctggttccttctctggaacttctacagagttacttctcatgcttcaggctttgctttcatctacttctgctggccagtaagttggtttcttgttcttgcagttctcctctgtagttttacacattttttttaacctactattcctgaaataagaaaaaaaacccatttctcaaatctacccttttttatggtaactacagaaaaagcacgccaaatattttcaaaaagagaggaaaagaatcataaaagccttgcagactctcttctatagttcataatttctttttttgcagattttttatttgaattagaaacaagattgttttacatgtcaatccctgttccctctccctcctctcctcccctaccatccccccaactaagaccctacctatcacatatcctttctgctccccagggagtaaagtccacacctatactagagataagtactgatctactgcaggaggtcccatagatttctgattgttcataatttctttctggttgttctggacaaaagaatagagtgttatataaattccaaagaatcttgtcactcagatggaatggtgaaaatatctttctgtctgacatgtaggtgtttaggcttttgtccatactgactagaactttgtaagttttcatagactgggccacagctaaccagctttcatgaaaatgacgatcattaaaaactgctcggaaaccctcttatgagcaacagtggcaattctcttttcttcccacatttgaactttagcttggactacgctgtgtggatggagaatggacttggcagaaggctggaagcaaggcttgttggtttcagttgtctccttcaggatcagtgtgcaactctgaatgtgttctagcatgttcatggaggaatgttcaagaaccaacccaggtgcatcaggcacaccttaagcattggcttgttcttttcttattagctaaagaagtcctttgacccagccataaaggagacactggaaagcacatctccccatcttagaggaggaactgcagggttacactgcaaagagtggaaataagggaaggtgagagctatcacccctgagtgaaaagctacagacaattaatggtcacctctccagcccccataattcctatatatctcagataatttccacaactctcagacatggtgtgatttttttttgtctttgaagatggtactcttccttgactctagcttgccttcttcctactgcctctcctcttcctgcttctctgattgtcaaaattccttaaaaaaagaactcccatagttttgttcatttctttttctctcagtatgttgaaaaaaaaatattaaaaccaatattctcttcccatttctccattgtaaataccctcctcacggacatcccagagccccagctggcccaaactgatgttagttacttgttttatttaatccagtttctgaagttatgcatctctgtatctgtcttcagaacatcaggatttcaagcatcccttttagtccactggttgctgcttctcatttggaccctgtggtttcttcgttttctaatctcttgacttactaactgactcattaaatatactgtcattaaagactgagggtgaacattttctgaacatgcttcccaggttgaattgctcttgtatgtttagatcttgtgtgtttcagaaatatccatgtctgttttgtagtttaaaaaatgattcaactgcattagtaaaatagagctacagccccctaccgccctcagtctgtatatgtgtacctcacagctaatgattagaaaatatcctcacttagtctggattgctaacacctttgccagagtggctttcctttcttaggttactacagcttcttttatcctaattctcagctcattttcttgttctgttagcagcaactcaccatacatagatcaatcagagaaaaatcatttgaaagtatttacatgtttataggaccatgccatctcctccttaaatctttcagcaaattgtaaacatttttctgcagctcatgaatatttcttagatgctgcaatataagatgtaaattgatctaattactttttatctgccagactcttatttatttggagaagactcctcgctgtggcttgcttctggacaaagtgtaaattggcctagattaatttagggtacaattatgaccaggaatatttatcctggtgactcgaggagcttaaatagggcagaaactcaagcagtgtctgttctgttattatttccagggcttgcctcattttgtctttatgttgctatgcaaaaggaaatataatttcagaaattaacaaactcataaaggaagtaatatataaataaaagtctatttcaatgcacatgataccatgttatttgttcttatttattctttgagaattttatactatacatatataatatgaatattatatacattgtatactcaatatatatatgtatatatacatacatacatacacacacacacacacacacacacacacactcactttgtagaccagactggcctcgaactcacagagatcagcttgcctctgcctctcaagtgttggagattaaatcatgtggcaccaagcctggcttcatacaatatatttttgtcattgccattctccttccaaaattcctcccagatctaattccctacccatacagttgcatattctctctttgtctctctctcacattctttctctctcacattctctctctctctctctctctctctctctctctctctctctctctctctcccacacttctttcagccctgaaaacccatggagcccagtttgtgttggctgtctactcttgggtgtggggcatgccctggagaaaccacactacttttgaattttacattttgtgaacttggataaatatatgtatttattaaatgccaattaaaaataacaatgatgtttacaacagtttctaaataaagtcagctaatgacatatcattcaggattgtgaactatttaaccatgtcaaattctgggatgtttgaaaaatataatgtatataaggaaaaaatcataatagagaagttgattagtggccaaagatattattttagtgatgattctattagttgtaattaatttttaggaaattaggtatgttgataaatgcctatttaattttccttcaagagaagcagatttttaagtaagaattcagatttattagtaaatgatacagtaacaccatgttttatagaaataaatgatgaaatatagggatgtttttagtctcccttgtttgttgtgcttcagtaacatatctctgaaatagtgtgaagtgaacaagcctcgttcatgacgagcattccaagtacccagtgcagaccagtggctctaagatgcaaatgtagacagcatgccccgaacatctaccacctcacatgtccaaacggccccaaaatgagttgtgatgagtctgctttttaatatcttagaacaactggtctctgaaatgtcatgattggagattttatggtgtcattgaaggtgaaataaaacatgaaagaattccagggaaaacatgcctgtgtgggatgtgacagggctgtgctgtgaaggcctggggctggaatggtgcaccttgtcaggtccatctactgtactgtcactcttggtcttcttctatacccatcagaatcatatgctcttgaattcatattagattaatattccaggtatttgttactgctttaaactttgcttggaaggagataagatattaaagtagaaacaggaagacacttgcaacctctgtctttcacctgtatgatgtacaacacacacacacatacacacacacacacacacacacacacacacacacacacacacatacgtttgtatatgtataaaatatagacataagtttagagagaacatggatgaaaaagacacctggctaagtgagtgagatggcttagagagcaaaaacaccagcaagccttaaggcataagcttgatccctgggacccatgtagtagaaggagagaactgactcccacaagttgttctcaatacttcacgtgttcactgtggcatgcatgtgcattcaaccacacaataaagaaatgtaaatttttaaaaagaaaaaagatacatgggccagctgtcaacatagttatgggccaactatgaacacataaactgggagacaagatctacaattattaaacagccaagtaatatgataaagtttaatgttgttgaaaggagcaaaatcaccatatggagagatcactgtaggcatccagaggtgatgggagagcttgtaggttcaagatacctttattcagataaataccagctaaacccaagccagagcgtgccaggggcagctgaacattaaggccagggagaaggggaaggagtaggggaaggagaaggggcttccatgagctctctgtaccttaagaacctatgtcatgtcattctgacctcactttggccacgccttgataggtgtggtcaggcacacctgtagccagcctctaacaggcgtggcttactgtcccctacacagaggtgggggcatgtgttctcagatgaaggggttaaaccatttcctaataacatatcaggaaatgtgttgtttggctaggtgctaaagcttggtcagagagcgaggtagggatgtggctttacagagatgaggtaccacagttaagctaacgcaagagtctattcctcccagacatgccacagggaaggaaacgaactcatttgttttatgcttaaaaactgacttgggcatatattgactcacaatgttgtgttatttattttgccactgtcccattaaaggtcctggtgtcagaggggaaagaaacaggagtggtttcatgtgatgaggaggtctgggcttcatctctgaactatcagtgatttggggtgagtctctttatttctcatctgtaaagaaaattcttacgtgggacgacctttgagaccatttccaactcagagcattcctcaagctggtataaaagtgagctgggaaaagggtgttttaggcagatttcttggcaacttttaattcaagctgcccaagtcacccttttctcatctcattctggaaggattgtggatatcctcagggacactgtatttgctacttcagaccatccagacccttaggtgtggaaagttgatctaaaagatttcccttttggttattctgcaagaagaataagttactttattcagttatatgaaaaccctttgagagtaaaatggttttaatgtttcatagagtcaaacaattttgaaaagcctggagaacattattcttatcatggcttagcaggtgtccccgggtcagaagattctctaaatatttaattcaaatctcacagagatttgtctgtcttatccttttaaacccgttgcacacttaatgtttattaagaaatatgaatgaaactgagtttataaaacttggtaatcttaatttggctcttttgtcagcatcagctagcatttattagtatcttactgcttctgggtgttgtattgttcataggggattcagtctattaggcttttcccctcaagaactcttcaatcaccctttcagtgttaagaaataggaactgaagctgtggggaacagttaacacccaataacacaataggtcaatgcaaggtttgcattcttttattgcctttgatacactgcatttatctacatatatacaatcatcatattatatattccttttcttctctttttacttaagtgtggcagccatagccaatttgcatatcaaccacctgctgtgggatgcacatctctataaaacgttattctacaatctggaataggtttaaaaatattgaaaagtaaatacatcattattaacctgtcatatccaatggcagtctcccagaaatacaaacagcaagcaaaatgagtgaactgtgatactgtgattctaaattagcccctaatttgtctacagcctggagaaaggagaacagcgggaggccagaggtgattttcctcatgcttgtctttgtgttgccacagagtgcaatgctgtgaagaaatggcttattatggagttcaaagcttccaatagaatccagacagacagataggattttgttcttgtctcaggggaaccacgaaagaaatggctcattcttgtatcatgcatgctcagtctatgcatgagatgtaactatgttgttccaagactgttgtgggatatttgtacacagtgtgaagatatattgccgtgattggtgtaatacaaagctgaatggtcaatagctaggtaggaggagtaggcagagtttccagagagaaaaaggaagaggaggtggaatctagatgcactgtagaagtcaggagccacagaaaaaaaacaggctgtgcaagatggaagaggggtaatgccatatgatagagtgcagatgaatataaatgggttaactaaagctataagagccagttaggattaagcctaagctatagacgaagctttcataactaataagaagtttccatgttgttatttgagctggtggcccaaagaaaaatccgtctacataagactatgtccaaagtgattccagtcatcttgtcttagtcaggttattattgccatgatgaaacaccatgatcaaagcaacttgaggaggaaaggatttatttgggttacaggctgtggttcagctagttcaaaattgctgtctaccaatggaagtgcaaaaatccagtagttgtttagtccacaacgctaggtgtctcagcttgccttcagtatactctggaatcctgaagaagtaggctataatgccagtgaaggaatagacttggcagtgagagtgagagcaagcaaagaaagcaagctttcttctaacatgtcctttgtataagctgtcagtagaaggtgtaacgcagatgaaaggtggatcttcgcacctcagaagatccaggtttaaagtggctcttgaagcttcaaagatttaattaagaaaaaaaccctcatgagtgtacccagccacttggacattagttaattgtagattgagaaccaagaatagccatcacaattttcaagtgattgcccattcctaatatggtgccattcttctacaaatcactgatgaatattccaataggcaaatccaattgcctcttattttttatacttactgacatcacttttttaaatttatgtattcatcttttcctagatttttatttaaattagaaacaatcttattttacatatcaatcccagttccttttctctcccatcctcccatgtccccatcaacccgccatcctatcctccttctgctccccagggagggtgagtccttctatggggatcatcaaagtctgtcacatcacttgagacagggcctaggccctgccccatgtgtttaggctgagagaccatccttctttggggagtggactctccaagtccattcgtatactagggataaatgctgatccactaccagaggccccatagaacgcccagacctgtaggggaagctgtagccacgccttcttaggggctggctataggtgtgcctgaccaggcttgtgagggcgtggtcagagtgatgtagggtgactgcgtttgcagtttcagtctctcctttcttcttgctgtacaggctgctgccacaggctggctaggtcgctctgtaagtaaggcttttccctattaaatacccttatatttctacctgactctgtattggtaatttcccactatatccggtgtcagaagcaggatattggaaacctacacctcatttgggacaggctgtgggtttcatcaggcccttggcctaggcccggaaagcgccctctctccacaggcgttcccggctagcagcctaccggctgcagctgagctgctcagagccctccacccagcccggagacagtttctagctgcctagaggtgagtaagcctcggctttcagcagaggcttcccctggccgctgctgcgggaaagccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatgaaacacctgttagaggaaatgttgattttgggtatacctacacaaataaaaattgacaatgcttcagtatatgcctctactaaattggaacagtttttcaaatattataacataaagcacgtaaccggtataccacacaatcctacaggacaagcagtggtgcagagatctaatagaactctgaaggagatgatccataaacaggctgtgataactaaaccccccaaacatatgttgcttaatgctttgttaactaactaaactttcttaatgccaatgagaaagggcaaacagctgcagaaaggcactggactatggaaaaaaactgctgaactgaatcagccggtatacttcaaagatgtactaacctatgtattgaaacaagggcatgtgttaggatgggctaggagttttgcattgatttccacaggagaagaaaaactttggataccatcaaagttgaacaagattcgaattgaaaagaaaaaaacctctcaacaaggaaaagtgacaggtattctaccaaggtacatctcataaactgtatagaagcctcataaaggaaagggaagtattttgttttatcttcacaggaaagctcacctccagaagtcaaaggacactgcatgggtggatacatagaaagagaaggtagctataaccattgaacaaaaggaatgtgccataatgtaaatattacatctatcctcagagaaccctatctctctttatttcatagtccctattcaattaaaccaatgctggctttagagttgcatttggctttcctcctctaaaatccaagcacattatttaactaaactttagtgtttctgtgttgtatcaagaagccaattgatataatacagaataaaagaagaatttggggactgtctttgtcttttcttggatctttctctccaaggtgtataccctctcataattgtatgctctcatggttgcattccccagcatgtgtacatacacaagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctggctacaggtgtgcctgaccatgcttgtgagggcgtggtcagagtgatgtagggtgactgcgtttgcggtttcagtctctcttttgcttcttgttgtacaggctgctgccaccggctagctaggttgctctgtaagtaaggcttttccctattaactacccttatatttctacctgactctgtattggtaatttcccactatacagacctcctaactgacacacacattcagggggcctggttcaatcctatggtggattcctagctctgacatcactcttttaaggctctaaacagtcttggtcatcttttctttttaaaattttcaccccttaaaaatcttttacacttaaaaaacagaaaaaaaagaacatgaaatagaaagtaaatttaaagagaaagacacccataaggttactctatggaaaaaccataacagttcagtctttcctttcaaagaacataacatttaaaatgattcatattatatatacttccttaaaaataatcttaacaatataagtataattttggaataagttgagcatccataatagttagaaatttgtggtgtacatgcgtgcatgtgtgtgtgtgtgtgtgtgtgtgtgtgtgtgtgtgtgtgtgtgtgtatgtgttcatttgtgcaggtacttgtgcatatgtatgtagaggtcagaggatgattttaagtgtcacttttcttcagttgctgttcacctgttttgatacagggtctctctctggtctggagcttgctggttaggctacacttgtcagccagcaaatcccagcaatgtgtatgtttcctctgcagagctgagactacaagcacacactacagttggatttttacatgcgtatgtggatggaactctgctcttcttggactttctggactgatctgtcttactagaccaatccctgtaacttgaagatgccaaatctcatatgtgcaaaaatataaatatttctagcttcatggactccctctattttgtttagcagcagaaaaacttaataagtaataatcaagctattcttgtctcttcaaatttaaaattcaaattctttacgacagtcaagttcgagtacatcatgcatcaccaactgagataagttctgtgaaatgcattgttaggttagttagcaacttcacagacatggagtgcacttataaaccctaagatggcaatgatttaatatggcaatcagaaggggacatgttgcaggatatttgatctcactttgtgttattaaaatcaactttagatcagggggagtgaagcccacaacaagtttacagaaattagttatagagtgtatggaggagtcaggaaaaaggatagaaagatacacaggatggagttaggaggtacttgagtttctcagtctttttgatttggaatggctggagagatgcttgccatcttgctgggtctccagccaaaaaaggaaggtcagctggctgcttcttggcctctctaagctagcagtttttcaccccaacatctaactcctgagtctttattggtaaatagaatgataaaacttagttaaaagttagatttggcggcagcagcagagttggtgctggtggaccggaaatccagccaggccacaaggtgggttgctgactgcagggccatgaggccacaggtggtagttaaaatatcagtagactcaggagtagctgctaagtcaactgaaaaataacagggccatcatcacacaggttgttgttcatctaaagatcattaagtagtgactgacagtactatgatctgaggcatctctcaaaatttgttctccatatagctttcctccttcaaaacctttctctgttctttcattcaaactctaactcactggtttattcctgtcttccaggggaagggagagggaagttaaggatgtatatgccatctgtaagttcctttttgcggtacttgtcatagctgtctttgagggacatggtttctgtcatgagaatacagactgaaaacatggaccaagaccagatagaggaggactctagtatctcccaagagagctcttgtctgttgtctttgcacagtcactgctgacatctttgacaccaatgaactgttggagttctggaacacgtggcaaggtctcaatgcaccagctgggcttcaagagccttcagaaacattgtgatcatttcttctcatgctgtcaccttggtactcctactgtttgtgatcattttgctccttggagctagaggctgtcaagttggctgcttccaaacagcattggaagcttgctctgtgcccacaaaacccatgtcttttatctcttgggatccgcttcttggttcttcagatgccagggggtatctgttaggttcccagttttacttctgtccttcttcctttccttccattctgcctatctttgaaaagatccagaagttaattctctacattttacatatcagacaagtaggcacagctgtacactctgaaaagagttcctcagaagtcaaccttgatgactgtccgcagtgatgatgatgcaacagacaaagtggatagggctctaccctgtttcagtttgtggcaacaaatatgtacatgtgtgatcttttggcacaatttcaatttacttcaagttatggcattgtgctctgcaacactattctgcatttgcacattgtaattgcaatggtaaggaacacaaagtgttttaaatttaagttctagatgtgatgccatcttgggttttaaatattatctcctctgtagtcattaacaagcctctgccttgaagagaagcccttccttgtttctttttttcttctgtgtaactgattattgaccatcctctgacttccttcattatgattctttacaaactcactcagactcagtgttcctgctttctcttcatttgcccagttcctgtaatttctctctagtgttgggcacctgtctaaattctagctccacacataaagcctcttgataactaccttacttcatagtcacactggccacttttactgaagctatcaggacgcaaatcatcaactgtgttactgttttgtgaaaagtagcactatgcttgtgatatgatgggagaataattatagcctggatatagaacatgacttacccaataagaataggattgggggcatctggaacacttgaaatttctgtgcctgtggactttttagctcattaattccaattgttaacacacagggaactagctgactaaaaggataagatttctatcagcaaataaataagcctatgcggagagtgggaaaaccttggtattgagtctacagcctctataataatacctaacacataatggttgattagtaaacatttttgtctagataactagaatgtacaaaacttatgattgaccatacctgaatacacatattgatatttatttctgacaaatgaatgaatcagatatacttgatataacattgacataaattctgactgagaaaataattagacttagaagaaatcatagatgcacacacatgcagacacacaaatacactcacacatagagacacacaaatacacagtaaaacaaaaattttaaaaagcaaagaaaaataactactcaaaccaaacaaaaaccaaaacaacaacaaaaacatccacaaaaaagaaaacaaatcacaatggcataagtcataattggtcattttaagtttaaaaaaaagtgatttacagaacatcttaatgtggattatagatgagaaaatggatcccttcttcttttattaattaactttattcatctattttatatcccaaccacaatttttccttcttcctgtcctcccattccctccctttccttcccttcccctcatccactcctcctctgtttctgttcagaaaagggcagggcactaataggtatcaatgaaacatggcatatcaaattgcagtaggactaagcacctccccttggattaagtaaggctgggccagggaatttggtatgaggactacgttccccaaagccagccaaagtgttctggacagctcttgctcacaatgctaggagttctacaagtagagcaagctacacaaccgtcacacatgtgtaaagggcctaagtcagtcccatgcaggatccctggctgttggtgcagattctgtgattcctatgagcccaggttagctgtctctgtggattccttgtgatgtccttacccccctgactcatacaatccttcccccctttttttcagcaagattccctgagctcatcccagtgtttggctgtgggtctctgtatctatttccatcagttatttagatgaagcctcacaattgttaggcaccaacctaggagaaaagcagaatatcactgggcatcatttcaatgacattttttttttctccaatcatgtttggttctattctatgtctctgggacgtccagaccagatcttgcctgaacatccctggtcttgtctgatcttagaagctaagcatggtagcagctgttagtacttggattaaaaaaatggacgctgctaataattttagataaataaaaataggaaagcttgaaatagatgtcatgttaccaagaaaaccaactaaagaggtgactctgcatgactctgttctttctaaatagtgcttctttgggtaattttctgacatgtagaactttgatgagatggtttctgttcactgatgcctggtgacaaatagtaagcaaacgctggccactttgtaagattccatgttaagtctgagaatagctgaagttcagccagtgtgtaaaatggaaaattctgattactctgtatagaacatgccagcaagtaggcagagcagagtcacagacaaggtcatattaagacacaggtagacaggtggtagctggaaggcaaacttttaaagagggatgatgacatcatcttaactctatgagactaggggtgaaggctaagtgagtttatcttgcctcatgaaaaacgtggttagagaatggattgggactaaccaaatcatggactcagctgtgggaactgagaaatcacagaccagaaaaataatttcccactcaaacctacttatctgcttgtaacgtgatttctgctacatattgaatcctccactcactcagtggtgaaaccctagcttctttcatgtttccactagacctccaattggtccaagcaattcaactctcagatgtctccagatatttcccatcttggtctctgctgtcatcaactcaatccatactttcttttatctcttgcttaatctgtcagtcttaatgagtctgctgatctcaaatgcattttctcagactattatattttatacaatgctgtcactccagttttcatgaaataaagatttaaccttagcattttccccattcacaacctccgtgtcttccctcttaatacagccttcctatcttcaatagccctccatctatgtttaaatctttccccatcttcaggaccaacttaagctcatttcttttccgagtccacaggacttatttttcttcttttgactcaggctttatctcagtctctctatgagaatgagttatgtggcaagaattcagagagaacaggatcagtctggactgcttgatttatgaatggtttgacctcatggaaacaaatctttagtgttctgatctcttttcttgtatgagttcagggacctcatccttaccattgtctcagggagcactaacttgcagactcacaaatgcagcatcctactgtttgtgttaagttatattcctgtattagtacaattgatagagatgaagctaattgagaccaaatttcaagatttatgctgggggaagtcagggctactagggattgtatttagttttccgaaatgctaaatccttcttcataaaaaagactaataaaaaaagactaataaaagttattgaagaaaatttgatgtatactcagagaacaattctatttttaaaatttattcttctctcatatattacatcctgactacagtttccccttcctcctttccttcccagttttccccaacttaccctctcccccagagcctttcagaaatagcaggtctcccagggatatcaactgaacttggcttaacaagttacaataagactatgcataaaccctcatattaaggctggccgtgacaacccagtcagagaaaaagggtccccaaagcaagtgaaatagtcagtgacagcccctgctcccagtgttaagtgtcccacaggaacagcaatctacaaaatcataacatatatgcagaggacctagctcagacccatacaggtccatgtttgctacttcaagctccttgagtccctatgagccttgcttagttgattctgtgggccatgctctttgtggtgtccttgacccctctggctcctacagtctttcctccccctctcccatgggattccctagctccacctaatgtttggctgtaggtctctgcatctgctcccaccatttgctggagaaagccactttgatgatgattgggctagaacatgtgggctagtctaaactgaggcccatgcaacgggaaggagcccatgtcccatactacctagattgccaggaactggaggctggatagcccagagatctaggatagaataaaaaacagctggccaaaacaaacaaacaacaacacaaaaataaagtcactgaaatgattcctaatgatactttggtatactcaaagattggtgcttagctcaactgtcatcagaaaacaatcccaaaccagatttctaattgtttttcctttttttgaaagtggatcaggagtgatgtaaaaatattgtcttccaagttgattactttgaagaaagttattcctcttcaggtcatttttgatatctgtcttgaaaaatagaataaagacttgtaaaagtaagctaaagatgttaagactattggtatcttttgcccgcatttatctgtttttattgtagttttttctgaaaattttgcagtgtctctgtgtgctttacttttcaaactgttaaaaaatccatggccattatctaatttactacttttaataacttttacccaagccattaggagaaagttcagctatgggagactcagggtcttgtgcagtttcctatgctgagcatttggaaaagcatctgctgaatattctaaacatacataattgttgggatccaaatcccagggcttggcatgagatcctaggccatgcatggaaggccacatagttgtatattaacctttacatagcagctccttacttaaaacctcagctcaagaaaagaaacaacttgacccagtcttccacccacaggctcagtcacctaggcaaccccttcctggacctgttactcatgaactctttaccttgacaaacatcttctttgtggcttcctaatatcctgcctatactaacacctggtacacaaacaacccattctgcccctccccatatcctgactatataagctaacctgagaaaagtaaagtttgtcacttgatcagaatcctgtcttgtggtcgttctttctgcgtctcttgtccccattccttatccctgtctcttgccccaggttgatgtcctgcaggtcggggcacacaatattattttcctgatgatgctctgtcaggaagatgattctagacagttttaatagcatggcttgtaactttcttagcagggacatatacacgtacatgaagtactgcagctcaccagttagcacttgctagggtgcacaagaaagatgacctagctcacagacagaagctcaggagatatatctccagttatttcaatctgtcttacatccatgcagcagaatccacttctcatcaaaggtttggggtaatcacttttcagttttgcaactgcaatctttatgtgcatataattatatgtaatagagaacttgattcttgaaatattgtaatagtgatttaatcttactatagaacctgtaaatataccctgtaaagtatttattaaatgatattgggtagcactcatttattttctcaccaaatccttgttagttctttctgtatgttagatatcactcaaatttggaagctataacaatcaaaaaataaagagttctgctcatatgtggcttatactgcaataagaaagaccaacagttaaaaattaaatggcatgtgaagaaagacgaggggtttgaggtctgtcaagaggctcagcagataaaagtgcttgctgccaagcctgatgacctgagtttgatcccctggaacccacatggtgaaaggagagaatggattcttccaagttatcctctggcagtcacgtgtgctgtggtacatgcatgtctacccctcaccccaacaataataaatatggatggcttaaaatcaggtgtggtggcttactcattctaatctcagcacacttgggaaagacaggagaatcagaagttgaaggttgtcttcagctgtgtaccaatctcaaggacagcctggaatatagaagatcctgtctgggataataaaaagataaatggtgatagatattacaaacaaaatagtgcagaaaagcatacatggaagggtttcggtggtcagttctcactgcaaaacgtgctagcaagtgtgaagatgattagcagctgatttagttaaaagggaaaaagaattccaattccagtcagtgaaatggcatgggtgtgttcccatgtactcctgaggcaacaatggtggacagacatgattgtggcaacttaataaagaggtttgctgaggtcatttattttatttgttgttctgcatgccccctgatagatctcttgcttgctcttgctctcctttccttcttctctctcctctaaaagggaggcaagtccatcaatgaggatgtagagaaagtatgactagtcacttgagacggagcatcaatagaacagaagagaggaggtagaatatatcaagtgagactaccaagcagggagcctttgctgtccagcaattcatctgcagcaggcctgggaggcataggcagagacttactattaaccagggtcatgttttagcagagcaggtatgttgaaatgtagaagggggtagaggaacaaggaggatggaaatgaattataataattaaccatgaaaatttaaaactgggtcaaaagggaaggatagtcattgcatgtacaatctgcatctagataaataagacacagattgtgcgtgtggagactattgaatgagtaccaccagcaggagaatcagggggcttaagatgcagagggagggtgtgctggatggagagaggaagtatgatgctcagattttgggaagatttgcagttgataatgatcaggttggggtatgccatggaagtgagtcgttaagattagatagggaacaaaatcaagggagtgagactttcaggtgtaggaacactcattcataggtatccaagccataggaatttcagggttaatgtagctgctgtctatttagtgtatgcccatgatgaggctgcattcaccccaggatgcaagttatgttcaacagaaaaacaggtcaactaatgtgacatgccaaatcataggatggagttcaggaaagataagatcattttaatagacaagaaaaatgcatgtgtttaaaataccaaggaagtcaggtataggagaaatgcacctaaatagaataaaaaccacttataaaggccagcagctaatattagactaaatggagaaaagctgatcactttctacttcaggcttggaataaaacaaggatgctccttgctggaaagtctagccagagaaatcaagaaagaaagaaaggcacccagattggaaaggaagaggtcagattatcattgtttactcataagaccaccaaacaggtcaatatccagaatatataaggaactccaaaacataaacaaaaccctcaaagaggttacaaaataggcaacagaattaaatagatatttttcaaaagaatatgagtaagttctcagcattacaaagaatcaagtcaaaccacagagagatatcactttaccccaagagtaatagtaaagatacgagtgttggtgagggtgtagagaaaaggaagccatggcatactgtgggtaaggatgaaaattagtatggaaaatagcatagaactacaattacaaaacagcagggtcactattcatagtagccaaagaatggaaaaaaaattctccaacagatgtgaactgataaatgaaatagaggcatagggcacaatggaatctgagtcagacataaaaagttctgtcatttgtcacaatgtggatggatagaagtgtcattataacaagtggagtaatccaggcacagaaagaagttccacgaggtctcattcatgcctggattataaagaggttgagaatggaagagtgtttagcagagccatagagaataggggacggaagaggggcatgaataacaccttgtggaacttctctttctgtgcctgacttaactccacttggtataataactggccaaccagtagctataaataaggagttcctgtgtgatactgaacagcaggataggtatagataatggtgatgtactatgcattccaaagttctagattctagatttttctcatccttcctaatgctgcaatctttaacacagtccctcatgttgtggtgaccccaaccataaagttattttcattgctacttcatacttgtaattttgctactgttatgaattgtaaatatctgatatacgtgatatctgatatgtgacccctgtgaaagggtaactcgacccccatcttaagaaatgctgtattaaatacttttagtgcttttgttataaattcattttaaattcttggttgtcatatggattggctagttttaaaagtcaatttaacacaacctagagtcatctggaggggagtatttgtttttcttttagtaatatttcatttatttgagatcaaatattggttttcttcctctcccacacctttttttcactatgcttttcaagctttctttttaaaaggaagcaattgcttatttatttgtaattatctgtttttgagattataatacaatcacgtcatttcttccttttttcttctttccaaaccctctcacacactcttccttctttgtttcgaaatcatgatctcttttttccattgttatttcatgtgtatatgtacaatatagtggttctcaacctaggggttgagtgaccctttcacagggattgtatatcagatagcctgaatattagctatttatattatgattcataacagtagcaaaattacagttatgaagtagcaacaaaataacttcatggttggaggtcaccacatcatgaggaactgtattaaagggtcacaacattagggaaggttgataccgtcctaaatataacctgctcagtctgtttagtgtttcttttatgtatatgacttcagcgatgaccacttggcattggataaccaattggatagtcaattggtgtggtcttgcctgggaaagatgatttctttcacttttagcatgcccaagttgcctgtcattctttgtgtggggctgaggtctcctgggatcccgtgtccacctgacatctaatgacagtggtcccatggctcagtctcttctaacttccttaactccttctaggttcctgattctactcaggagttttaggcttagcttctctctcatacaaagaacttcaaatctcagactcaggatgtcagggacataagaatctatgttttggggccatctggctcgaattgctcatgaagcatcttttctacttagaccaatggctttgttttaggttcattgtatcacaaatcatgaatgtatttaaatgttacttaaacaggatttaattttattaaagtagaaggctacctatttcaaatggctacctattttttgagtatcagcattttatgtcacatcttattagaaaaaatatacataaaaattttaatagcagaatccatttctcccagaatgattagtagacagaaaaatggaagcaagagcctgagtaataagtatttgccaaaatgattagtttgaccttcaataatagaataatttttattttgaatcattcagtgttcctgaccctcaaaatagtactgttaagtgcttggcaatttttctgtcccagctgtgattaagccccccactaagaaggtgagccctagccaggcccagccagcactgatttgctctgcagtaggactttgctcacaaataaggcttctggacttgcaggttctgaagtcaagaaaaatgcaaggtggaagtctgacaaggtggaacagaaagttattatttcacaataaacctcgggcgaacaaacactaattattaagtggtctacttcagtgataatagggattagaaacaattgatttaattaaatagcagaagtatttttattgagaaatttgaatttctgttagaggataacaggaagaagcaacttgaagtgatcttttgccatttcaagggcagaggtgtggaatcaactggcatgggttttagttcagcttaaaaacaatataggcttcctctgggacctggtgtccctcaggcagaaaacaatgttggaccagaaggagtctaaggcaacagctgccaaaccctgttcagaggcactgaggcccaggctgaatcaaagttcttccactactacttggatcagcttctcagcatagctatgaaaacagcatatgaaaacagacatgataactgtatttacctcattagggtgtttgagatctgagtgaatcctgcaaagcatatgtttagtggagtgattgatacatactagatgctgaataaatacactaatatttttgttgctctttgccttgtttacagaaagtatgccctgttagttataaacatagatcttcatcctccccttttatgtagctctatttatcttaattgaatgtgagaaacaagacactataaaatttcctggagtagctagaatctgcatattcattactggtgttgtattgcagccattacattgacatagaatctcagtggtttaattctagtagctatatctgcagttacaatttctccactcaaattaccatgagtcataaagaaaatcttcacatttggtcagcactgcttctcatgcacagataactgagtgttgagcttaagtgattgagataactagctctattctaatcatattcctcatcttaagtaagaaaaaaattactgtatattcattacactggtctcctggattatcaaaggcctgttttcagtacaatgtgtgtgaactttgggtttatttcccagtgccactcagtgaccagcatttagcttggacacttacatttatctcagactccatgaagcttgagagaaatatttaagaaaaaaaggttctgaaaaggaaagcattagaatggcaattttgatgttcctgcttttgtaataatgagcccaaagtaatcaagggacttctgtgaccactaggcaattgaccacatttaggtgctaggtcaaattacattaattaagttgatcacaaattatagtctaaagcaccactaccccatgcaatcaattaccttaggtacacaatactgtgattaagaatccagttctacatcatggttacccagttcttgcctgctaaatgagacatttcaagtagcttaagtctggcagctaacactgcatggtctttactgtagattggaaaagaggaagcatcattctggactatggaaacattatgtagcctaggcttttacagtcctaaaagactggcagattagacattttagagaggatgtatgatacatcattgggggatgaaacctaattctgtaatagctgtcttttaagccagttcctaaaacacatattttgaaatacttctttttcactaagaattctcaaggctttgaggcatcttgtggaccttggacattttcacatacaagtccaaatagtttttttcagtgattaaaaatgtctttctgcctagaaaggcatatcttctgaatgaaaggggaggaggttctttgtcttctgcctgctcttctccctgagtactccatccgtcagtcatgatgagggagactagaccttggcttccagtaagatggcccggccttccaacaagctcctttcctatcagctgagtgataaagaaactcaggccttaggagattataagggctatgaaacaaaaatctttatgtcttagttatttttctgctgctctgataagtactctgaccaaagcaacttaagtccgttttggctcacagttgcaagttatggttgatcatgatgggaaagtcacagtggctggagcctggtgtagttggattgttaaaatagattatttgcaccaaaaccaccaaggactaacaaaaaggccaacaagtgtgctccatgcaggtccccatgcatcagatcactgagggcagaagtctgggttctgtcctttaaaatgacttttctggtgatgcttagttcactgaagagctttctaggcacatttcctgtcagaacctcttggcacttatggttgctttctgtagcagtgacagaaataattgtagttcttggtatctaatactgatgccaactaaacaccaggagccacactacatgttttatactcatatatcctccttgaaacatccaggttagaaagtagaagcaacacatcttgtgagtacaacgtctggaattcatttcaggcctgcttagtgtcaggtgttaccattaggattcccacagctgactctctacttggaatttaggattttttttccttatctctagaattcttggctttcttgttcttctcacttaccctacatgcttatttcttgcttctgcttttaggcagggccttgagcttatagtgtagtcaagactggtcttgaatttcttgaccccatgtctttgactccagaatgcttcaattactggtctacaccatcatgacaggaatgaaactagacttcatgcatgctagcttagcaagcactctgccaatagatcctcatctacagtcaaccacacactcacctgttgatctgcagcagccatattcctttctttcccaggacagacttatttctctaatatatagccttttatgtttagatctgactcaggttctcaggcagattatgccatcccttgggacttcaaattggcttgtccactatgacattaaaatgtgggagagaggtcaaccttgactgttgtccccactgtgctcttgtgtttgttaggacctgattgttattgatgctctgatttattgagactgagtcctacttctgtgcctacaataattctactgtcatggctgacctgttcataaaacctaactcaattttcttgttttgtcccaatgcaatattatactttgaaggcattgtgcatgttgtattgaacagataaatggataccttttgtcatcctaggaggatttctttcctattaagtgttagtcttaggcttccagattgttaacaggaccaacaactgactatgctacactagccctattctttgctttggttttctcttctctactgctgcctacttgaaattctaatactggcacatgcagagtctcaattgtaggatgtgtgttatgagcagagagtactgtgcaacagagatttcaggatcagatggagtgacaaggaggaccactcagagatgtgtggagaatctcactgtgaaacatggatttttaagattcattctcattgctcaaggacttagcttactactcttttgttcctaaatataagctacatgcacacacttttacacatcaacaaacaggtatttggatacccgctgtgttcctgtcatctctatatgggaaggaattcatataatggagctaaaggagtggtgagaaggcaaatgggatggtctgggcatccttaccagaataacaggtcataactgaatttatttgaaggcctatcatgacctttgagtagtgaactagtatgagctctgggttcagaccatgccatttctgctcaccaactcattagacaaatatcaccctaacatatttgatgggccacctgtatttctctccttccttcacatatcttcactctggtgtcttctccaataaaaccacccaaactgtctttattaaggtcacaaatgactttgaaactttacttttgatagaaaagtatctgttctctctctcttttatctttttgcaatctgtgatacaattatcattgtttcctctaaggatttgaagttcaaaataatagcatgtatttatgtcaagagaatatatttttatgtgcttggttaatgcatgcagccagaaaagtacaaatgagtttaacactaaatttcctctctcttggagtccatagatgtctcatcattgactcttagacacacaaatcctgggcctggccccaggaaaccagtaatcttatttctatcattttattaatacaaaatatacaaattagtgcctatttccttttacttagcatgatatttgaaatgcattcttgtggttccatgtattagcaattcattctttttttattatagtgtaatagtccattgcatggatatactacactttgcttagctacttgatggatattgtgttttgttcattttttttaagtcatactaaatacttctgtcagattttttatcctgtggttcatttctagttctattttgcttttaaataatttaaagttggttatcaccaatttacagcctatcttattctctgctttgcacttgaaagatggtgttctgttgggttgagtggtctatagatgcgaatgagatcaagtagttttatagtgttttccaattcttttacacccttcatatattcacgctatattgggttgaggaatgcactcagtgccacatttttctgtatttcctcaggcctttgacattcatcaggctccctggaggtcttttatattcatcctttataccaaagttgtgaaatttattacattagtacttcttaagcttcttcatgtccctgctatcccagtgaaaaccttaaaacatatttttatttatcctttgagaatttcatatatgtatacaaatgtgttttgacacctccccagtccctggtctccaactcctcccacatcctcccagtatatctcttttccaactttattagtctgtctttaccacagagtccagtgagtgttgttgagaggtgcatgatgtaggatcagcctgggagcatggggaacatatatgggccatatctctgaagaaatctgatggccattcccccacagacatcagctgccaatgtttccttaactaggggaattatcacttactttcttagctaacctggacagagtctactaagtgaagccctaggtttccaatataaacttgtggagtcagcacttacaaaaaggccaactcttagttgagaaggaagtttactacaggcaaaccattatgagcttgttaatggcttttggttgttttgggcatgtctagaagaatttctaagtaattctgtctacattaatactcagtttatgaagactcaaacaatgcttttctctcattatagcattcactgcagatgtcaactccctctttcagaaacagtctcctcagctgccacacaattaatgtcttcctatctttctcgacactcctcccttaagctttaagtcatttggatattcatatgcattggtatttaggacaagttgcccattttaaagaaattgctttttttggcttcttgcatgatgtcttccttataaatgatcatattgatccccatgggtttaattggctctgaattcttacatccatcatagacttttcctttgaactccagatccttctatttatcaacttatcatatattttccctcatttactttattggcagctcaaacacaagtccaaaatagagtgtgatcttttttgtctcactggctcatgaatattgtcaccatttccattattcttgttgtccttagtaggcccacatctttccacagatcttcactaatgatcattattatttcctatcttatcttctaagtacctgcttgataggaccattttttttcatggtcattatatgaatcttatctataagcatatttttgaaccacttaaaatcattttttttctctagattcctagcgtcatcttttacagattttaaaaaagttattgtgatctttttcttaaagccatttccatatatttatttttctgttaggataatgataaaaaaattctgtatgatatatgtggtccagcatgttctgcctctcttgactgttccagccttaggatctgctgttggtcccagtgttcctcagtccacaaggatctcctttcagcttttcaacactggccttccaggactctctgagactacccttttatctgtttccacatacatggtatctttccatagtgtctagtatttatattatgaagatatttgcttcatgatttccatgttcatctataggctccacactgaagcgacctgttattgatcacggataatggaataccaagtacaggccagattctcaagaagatatgcttgaattaaagccaaagaactaagtttatacttattggccttgttttgtctgtattggttacacttttgcttcggtcactaacatatctgataacttcaacttaagtgaggaaaggttcatttggctcacattttgtctaccatggcagggaagatctggagacactcacggctcacccatggcatcatggcatgagatggctgcaactctcaagaagcagaccaggactagtgacaagcatttgaagaccttctcctagtgacttactcccaccagttggtcccagtcttctaaggttctatagcccccaaacagggttactggataggggactaacttcctcaaacattagcctgtaagggtggatttctcattcaaaccataatagcatctctatattatcattttccttaaatttttttttaataaatatattttgattgttttgcccctcagaaaactcctcccatatattctctaccttcctacccatcaacttcacaatctttctctctctctcaaaacaaacaaacaaaaaccagacagaacaataaaaaatcaaaacaaacaaaaaaaaccccagtaaaataaaaatgccccaaagcccagaaaaacaaaaccaacaaaacaaaccatggtgtctcttacattggccgactactgctgtgcatagggcctgctctggagagtggttgacacacccagagatacctgattgtagaaaattgattttccctgccaatgggtatcaattgcaaatggcttcatggttagggtgggaacccatgtccatttcttcctatcagtgctgggaccccatctagcttgagcctgtgtaggtcttctgcatgctggcacagtctctgcgagttcaccagtccagttgtctacaaaagatccctaagctttgaggggaggagtgtgatgaaggtatgcctttgtatggttctctcacttgtaagctggtactggcaatattacacaccacatagaattaaagtgcttacaagaacaattgtcacttatacacagcatccagaagtctagttagtctttcaaatcatagctcttgcttaagttcccaaacattatagaccacttgctacttagttgtactgtataagaagtcttacgggacaggaatttgtacattggcccctcagttagactatatgttctctgaaagaactatggctttaccaaagtgcctcacaatgaaaagcctaccgtaaatatttgtgaatagctttctttcaaaatattttgcatttcaaggttttcattcagactctattctttaattctctttaattttattcatttgcctgtctccaactcccagagctgttttcactagagtaggcccatgccagagactatgactttgaaattagtatcagttagaataatctataactaggttagcatggactaggctaactccagagctactggctccttcatgtcttctgactgctgtgacttgctgatacccacttattaaaatgtttaaactaccaaggaccatggggcagctttgctatcaaagcacattccaataaaacaaaaaggaaattgaaagagctgtcagcatcaaataaggtaaccagctaccagggacacctttcaatcagttggagtcaggtgccaatcatacaggtacaattgagtagaggtgaacacaaataggtcagctacatgaactattttaacaggctggtcaaggtgcaaaaaggaaacaaagcaagagaaaaagaatctaatttgctgtacttgtatgcgtttgagagggagttaaagtcaagtgtgattttggtggggacactggtcattaagccgatccctatttgagggagaatttctgcttctctaattggttgatgtcacacaggcaggcctcacctcagagcaatgctgccttgcctgcctgctctcagctgggaaggcccacagctgagctgagagttgaatggaaagcagctttacttgttgtgtgagggcttcccatctgcagctctccacagggagcaaggttgatttagaaagggattttcggaggcaaagagaggaggggcgctgacattctcagagcagagctcctttggtctgctttaatcatgaccaaaagcttacaagaaacaaccactgctcacctcctgttttccctgtgtcctatctatccctacaacatcttcttcaaattaaggggaaatgtcagggtcccgctcctgttcctttacagttcaattctgaagagttacttttatttttctgttttatcttgaattttacttccgtgaccgacaagagggctttctttttttaaagcttccccactctgtatattcctccccatggctgtccaattttctcttgcatttcattgaaacttactcccagagcatgtgataaagctgatcaaaaagtaggtaacttgtaatctctaacttcaagtaaatcatggaagattaattttatcttctataaaagatggaatagtgtgtgaaatgggcaatttgaatattttcagggtagcggagtcttgccttacttgattgctttaaaccaattggagagattaaaaacaagaaaaaaaaactgaacacttgctctccccatctcttcccctaccaggcactcactcctttatgaagctcacattgacagcgtaatgaacgcacagcacagctgtcaaaggcaatgtttgagcagttgtgaaattgcaggctgcggcacaaacgactcaagcatgccattacctcttgctgcatttagaacaaataagccacctgccctttaggtattatctggtctgtttcaataggctgctgtatggacccccacagaaaatttcaaacactttcttctttggcttctgctcagagaactgcagcttcagcagctcactctctcctttctcagtgctttcctctccggctcagccccttgcaatgcatcatataaacagccacgcatcttccaagctgtgttaaaggaagtctcatcttcccggtcacagttacttcaccttgggctgctctatctgcaagctatcatagtctgtcttgaaaacttggtgtatgttgttacctggaaagtggttttcttgattgtgattctgtctcacagccaaatgcagttttctgttagacacaggcttattagaagtgttctaggattgaattatcaatttgagatggggacattaattaagctacgatggcagcatggttgtggcttttaagttcttattagaagaaactccaggataccgctcttgcctttctgtactcttgctctagagtctagtatggggaatttggtgtctcctacacctgactcactgagattggataagttgaggaaaacttgacaaaggaatctctaggatatggattaggtatggggcaaacaccagggagcatgtgaaattcttgtggctggttgctgtgatagagagttctgattgtccacttcagaggagttagaatcacttaggaggcaaacccctgggcatgactgaaagagggtctctagactggtttaattgaactaggaagacccaccctaagcatgggcagtaccattccatgggctagggtcccagactgaatggaaaagcagagagccatcaccttgagtactagcattcctctctgcatgaggatgaaatgtaatcagcttccctcaaacttctctcatcaggccttccagccatgccacaattaatcttccttccttaagttgctctggctaggaatcttgtcacagcccaggaaaggtaactcacacactgttcttactatagtcctgaagaagcaaggtagagaggctggaccttagagacaggttgtgagtatcgatcatgagatggtccagtaggcagaggcatggactttcatagccatctaaggagggaactatgatcagtttgtaaagggcaagagtgattaactgattaggatttgaatagttaaagggagtttgcactgctgaaggtccagagcctaatcacaacttttcttgggctatttttagctccctaaatagccattccttgctcacctgtgttagacccaatattctgggactaagagattgcaaaccttttggaatgcataaacaaaactatagtttctaccaaaccaaaaagacatgtcatcagatagcacccgaagcatatggctgagatgtctctgctttgcttgcttaatgtttccatccatatattcaaaaagggtcctgatttatgatttcctttgttctgttacttaaaaacttaatggaattgcttctactttggaatatgggatttggagtaatgcttaaggtaggccaggctaagatgagtggagcagtagattgggcgtagaacagtcatttttttttttaaatgtggtatatgcatacacatacttatttattattttgcactgtgtgtactttggtgcaaggcacaaagacatgtgcatggaggtcagaggacaaatctcaggagtctcttctcttcttccactatggagattcttgttctggttggttgtgtgtgtcaatttgacacaggctagagtcatcagagaggaaggagcctcagttgatgaaatgtctccatgagatccagctgtaaggcattttatcaattagtgatcaatggggagagggcccagcccatggtgggtgctgccatccatggactgactggtgggtctgggttctataagaaggtgagctgagcaaggcactaagtagcacccctccatgggccctccatcagctggtacctccaggattctgccctgtttgagtttctgtgctgatttccttcagtaatgagcaaaaatgtgaaagtatacatcagtcaaataaaccctttcccgccaacttgcttttttggccatgatgtttaatctcatcaatagaaacccaaagacagtcctagggatagaattcaggtcatcaggcttggtagcaaatgcttttatccactgagctatcaagctgagcaaattcatgatatttgcaacttaaaatgagtttatcagggtgtaatccagggtagttgaagaatatctgtactttaaacttgttctttcccagattgtgtgggtcctcaccagtgatgaatttaaataaaaactagattaaatagtattcaatgtaaacactctctcaggatggggtgggggtgagggtgactagctctgagggtacacagagagtatcaagctcacccctgaaggtaaacatatgtctccttcagaagtttccttttcttagtcacctccctcagctccaatccatcttttaagcttcaacagtgttatcctgaaagcacggctgattgtatcatctctttactgactaacctttaatggctcatgccatagagcatgaattccaagttctttatcatgagattcaaggccacacaaatcttctttccaattaacttaggagacttttccaaccacttcccttagaccctaatctatttccttaacctgatagcattctggattttctcacagtccattcctaagttcactttcttcttcttatctcaattgctcttaagttgttcccgataaacccttccttctgtaaggttggtctcaaatatcacattcctatgaagtaccctgtgttgtcctaattggaagcaatcctctaaaatactgttcccctaaaatactgtaacacaactctgtcctatgattgattgagacatatctcctgacagattatgaactatgcaaaactctgtggctctgggtttgattagaaagaactcttgatcttatagatttttttgttctaggttgggacatgacaggagtggtcagaagtgagggggaattcataggtgaattcatcccatgcctgagtagggttataggaagaaagccaagggatgctcatttgtctctgaaatgaataaatgaaagtctggagggtgggacatagaaaataatcagaaaaaagaaattcagaagtaaatagtcttcaagcagtaggaaagatgtgaataggttgtcagggatgtttaggagctctggtcaccttcagcactgtcttttttctgggcatttataaaaagagttgggtcaggtcaggaacataggtccttcaaggtttggagccactcttagttatctttgtgatcatctctctgtctcttttatccatgcctccttaacagtgtcttgaatttagcaggtccactgaatatgtttgttgaaaagattcaacgtcaacagattttatttacataaaaatactgtatgagatgtgaacagatatgtgtatacatgatgatattttgggaacaattaaaagacagtctgtttcagcagtttaaaaaaatgaatcttttctgttttctgtgtagactacccttcaggtaaacatgtattcaatagtgtctgtatagttgggatatcttgagtatttggtgtctatgcttatccagtatttgtgtgaagtctgagtcactggggtaggaaaaatcaggaagagcatttgcccactgtagtctttactatgttggtcagattctttgactccatgacactttggagtatcacatgaattccataatttaatgttctgtgcttcaaaattggcagggtgagttttgatgacaacgttggattttggatctcaagattgttcctaagccaaatttaagatgatatctatgagcaccaaaacatggaaatcttcattgtgaatcactagaggcatattagagtcacttgcagagattggaaacatgttgatatttacatatgtcctttttccccactataaaatatgatttaaggcctttgagtataacctgcatttcccaagctaagcaagtaaatagcaaataggtagcaaagcaccacagccacccatgatggggaatagactctgaaacatcagttcatgtaatagctctgccatttagacctctataacaacaggcttctgtgtacctttgtttccctctcaggttcaaaacaatctgtatttcagaatgttcaggtaagttcctattaataaggttaacaaatccttggcataacctgttctatacaagggttcagggctgtttacctttgtcatcaacatcagttacagagaagagttaagatttccaggtatggctggggaggctctggcatcaccaaagcttgttcaaaggctagcagctgtctgtgcagtaaacagaaatgggaacaaagggtcgacttgtggagattttgattagatgaatcatgcagaagaacatttggcagactgagccctttaaaagctaataaataaatggctatctaaggcagtggattctcagtctctggtctgtttacttggaactttgtagagtatagtaggaatttgcctatgaatacaactgataaggtctgaaaatgttttgttctactctaaaaagaccaatgttcaactacttattagtaccattaatatttctaagatgtagaacttagagtccacaatcctttttaagagtctcatacaatgtatttttaaaactgtgatcatgttcatccctgctaccccagctcctctcagattcatccctacctctctacttatccaactctcttccctctctccccctccctccctatctttctctaaagctcatccagtctagtttttctgatttctttaggactgagaactccccagtctcttattctccacatagttaccagctgtggttccccctgttaattgccatctactgcaacaaggtgctttatagggggcactgtagccacaccttctagaggctggctacagatgtgcctgaccacgcccattagggcgtggtcaaggtgatgtcagggtgatgcgggatagggtttaaagggacagacaaggcacttagtaggcccctctctggcctcctttgccttgctgcttctggcacattctggcttgagggctgagagatgcactgatctattggtatagcagtaagtcgtcaatatcacttgagtcataaccatggagaaatcaaatgacattgacatggcagcttcatccatactggctagctttcacagtgctggaaggttctatgagttcaggaggaaaaaagtaatcatgaatttcacccagctatgagctcttccagctacagtagctactggacaggcaatggtgcaatactggcaagagtgttatgaacgtaaccattcagtttctgattggatttaaggactgcttcaagagctggaacccatacctgagactgccaacaaggccaagaacaagttctagataggtaaaaagccttaggggagagcctatcttttattcaggtaagcggacatagtattagggctaagttatgtaatgttataccacttagaatgtaatgctatataaacgcattttaactgtgtaaacgcattttcaatatgaaattcaaggaacaaaatttacttacagcaaaaagccatttttaaagtaatgtctttgatgtagctcccttgagataccattgttagacatagttatagttatgtactgcaatctctgtcttgaatattaagaataaacagaacattgttagatctctgttatattttgtgtttaaagaatatctatagtaatagtaaaattaaaggggaatggaaatatgtgcatatgtatctttttgaatgtattattatctagtttatagattgtaccatgttttatattcatttaccaaccataagttagcaggacttgcaggcatattcttcacagactgaggtgggagaattgcaagttcaaagcccttgtgggatttagagtgaattcaagggcaggctggactacttaaaaagaccttctctcaaaataataataccaagaatatagttcagtagtagaatgattacctagcaaacataatgccctaggtccaatccacggtatcagataaaataaggcaaagcaaactgagccaaagaaaaatcagactaaaccagaaagcaatcataaattgatcacacaaactgctgagaggctttgctggcacgctatggaacatttctctctgtgaaaaatgattttccaggaaacccactaggttgaaactctgtgttattggggaggatctgggtctctttagtcacctagcatagcctatttggtgatttccaggccactgaatgaccctagaaataaacaagttgaatggcattgccaagtctttcttctggcctccctccctccctcccttatcttagtctcttacaccccctctgtagactcagctgtttcttttcatattcccatagtaactttttacttttgcttaagtgcttgctatattgagctctgtttgctcatgttttctatttcccaagctgggccatggggagagttgttttgtagttctgggcccaacatggcgcctggcttcttagttgctcacttatatgtttgctgaatggtggatgaattattgaaatatcacagccaaaaatttgcaaagcataaaataagtgatcagtaatacagtgtaattgaatcgaccctagagccagaatcagttatgagacttgagaaattgcaagacaaaagagagagcccaggaaagtgttaaatgggtatagcagttttcatggtacagaatactctctgagggaaggatgaagaattattaataaattaaataactgtcctgatgatccaagcagtggtgcaaacaagctgaaaaagacagtcataaaataatgctacagactggtgtgtgattacaaattacagaaaaccatatttaaggagtaactttatcacatcaagactgattggcctgagataacacaggtaaaatataattgtgagctcatagatatttgatatgcatatttgcttatatatgcatgtgtgtctttttctgcatgtatgccactgtaatgacaaccacactgatttagccaatgaaaagttttaaattctcttcactgatggccagaccaagagtatgtgcgtgcctctgaatggtctctttatacccaagcttggggatacagagtttttaaaggcaaaacccacaaagacatatcagagttagatgagagttagagcaaccttgaaaaattcattcctggcagggcataggagttattttagacataacttgccaattattttggttattacatctggaccatggacaaggccatgggaatttcaaatgtgttgccaaagcagacacgaattttgtgggatgtaggacacacataaaatggagtcagaacaggaagatgttgccttagtcatttcaccacatgtgtaggcagccaaataggccagaggagggtgttgtatcacagggagctggagttagaagtaattgtaagctactgaacctgggggctagggtctgaacttgagttttctggaagagtagcaaaggctcttaactactgagacatctttccagccctaagacatgcggttttaagaatgaaatccccattttttatttttatttttatgactttgatctgaggatagggtgataatcagaaaaaaggtcctataatgaagacactaggacgcactttctttggcatcaccagcaagttttatgtagagttgcagacacccttgggatcccagagaaaaccagtggtctggagttttatttctatgaaaaaggtctgttcttctatgtgactgcttcacattgccagtgcttcctgtatcacaaggcagtctgctccctatctgttgctcctccccttccctgccaaaactgttgagacaaaatcaaagtttaaaacccgtgcaggattcataggtcctagaaagccaggctctgaaaccctgggaacctggagctttcatttggcctgtcaggaaaagacccccattcctaatttgaattaggccagagctacagagaatcatttgagtagctgctggttaatgagctgtggtttacaggttgggcctccacatgcctcccctggagtacatggcaggctaagtaatccactctcattataatgtacgctcaagaagctgcccatttggaggcagcgtaatgatgtggtgttatgatgttatatatcacagaaattagagcggaggaacaagagctggtaggtcatcttgactctcccctgccagggcagccttgctccccacaacgtttccttgaatgcttttgtccagtctggttttaaatgacccaggcaatggcgctcaaacattgtcccttgagaggccatttggctgtctaataggctcgctgttagcaagctcttctagatgtgtggtccaagttttctttgctcagtttcatctcatcactgctgttattccgcgtctatgcatcccaaacaattcctctccctccttcctgtttacccttccccagctccacaaatgacttcctgtcccctttagtcactgccacccccttttcaaagtttcttttcttcttccacccatattttctgctctcctctgggttcttccccctttgatagaacttccctgatttgttagggccggaggaacatgctgtatttcatgctagatgatgcctcctaagggcaacatcgaggcgttcttccctggctgtgacagatgtgcttgtgtacacagcctcaaattgcattgcttccctctgctgtcaagccccagtaaggaagttgaggcctgatgtactatcagggctcacaatctgttgagcaagcaagcagagttactcacctggcaactgtgattgtgtctttgaatttggccatttttctttggaaaactctgcattgggctcacagtttgattaaagtttgattaaggactgaagaggaaaacaaattgcccaaataacaacattaaaaataataacacggtgttctctgaaaagcagaaatgcatttctttacctggtaattgtagggtggtgacggataaagtgaatgagctctggtttcacccactctcttaaatgagaggagggaagcacatggaattgggaacaatggtcttttaaaaaaaatagcacagttttcaaacttgcagggattggcaaatgaaagaaaagcaaaaggagagattattaaaacttacctgcctcatgctccctccagtcaagtacctgcatatgttacataggctgcatggctacagccttctgggttttctaaaatactttggcaaacttaaattatattctctggattgtaaatacaccttcaataaaatatttattgcatcataatttgacattgtgtggatctgttagtagtctgaattcctttctctagtaatggtgatataatggttcaaaaaccatttgttatttgttatagtttgtgactcaacttcacctatagttgactcatttgttcactgtgagtcaacttacttgggagtttgtgtcctaacttgcttctcttataatctgcagcactgactcactcttcataaaatgatcaggggaaacattacattttccccttcttgattcaccttagtacatttgtgcaaggcaggttaatattggcatggcatgtctgtcccagtgttctgcgctacaataggacttgctacaacttaggaagtttgactgaccatgaaaaccactgcacatccattggcctacatttctattagttaaaaatcaactgaaatcagattatgtagtatttaggcattgatactatggtatgattttgagttctgctgctacatggcattttagctaatcatataactgtgatgcctactggtgctattctggtaactcctggaggtgatgggagaagggtgaaatacaaagagaataaggcttgttgttagagccaaaactaatatgaaaataaaaaaaaaaaaaaaacaggtagttctgacactgggaaacaattctacaaatccatagttttatgttttaagtgttacaataaagccccaaagtttaaatataagtgagaaaagggaaaaatattggggcttactttaaaaattatgatgtattgtctgccaggaatagtgataaaatctgtgtgtggattatttctcttaatatcactgaatgcctccttgcatttcacacatgatgctcataaaagttaactaatgtgattaaaggtgcactgatattaaatggtgcagttaagatgtgatatttcaatacaggtactattaagtaccctgagagaaggactccaatagggcactgaagatggatactattagctgtgtaagcagtgcatttgtgacattatttggcagctgaccaagggtactagtagtgcttgacctctctgctcacagctactcttctttcatgagctcccccagggagaaacacacacaggaaacaatagcccagggtgagtcagacaccatgctctcaacagtgcacaggacccagtgtaaatgaggctctttctccaattctcttaaatccttctttaccacacttgacacaaagggtgccagattgcctgacaacaattgtgactagaaaagagacaaggtcactagtccatccaaggttacatgtcctgattcaatctagtatttgatgagtttggaggactcaagaacaccagagagagggaagtagtgcctacctatattaattatttgttccatgctagctcaagagacatttgtgacccaattatagctatgaaagattccattcagaataatcacaaaagaaagaggatgcagagattttttttcattatatgcatgataatgaagctaagaaggaacccattatttcatgatgggaaagatgtgttaaataagatgacactggagaagtagagtcttgggttttgaatatataaacaacccttgatatattacagggcttttccctaccagctcactgtatgttgaaaatgtggtaagccaaagatgcatttaatacatctagcctcctaaatggcatataataacaacagtggagtacgaagtgttgtgcatttaccctcaatgatggtatgcatggctagaaactacagttgacccccaaactgaatttccaagacagtatcatattgcataaatctattccaggaaaagatcaaaactcaaaatctgaagtatgcttttttttttttttgtatgtattgcttttgtgccctattaaagtggagaaacttcaagtcaaactcagtaacatgctgtgtgggaaccattaatacagagttgaaagaactgatgggcatgaactgattagagatgccatacacacgactgtgtctatgtagatgaaggatgacggatggagaaattgaatgtgtatgtcattttcatagtgatgccaagaaagaacagagggctagtcaatggaatctgcaagagaatccactgagtcattgttagcaagacagtccaagaaggggctacatgaaatgggcattagggggttggggatggcagaggaagggataataatttccagaaaatcccagttattcaaaatcacattagaaagaccacgagggtgaccaaccctgcaggacttgaaaaatgacttttgagagaacagtcttggtagaatgggaataataaaatttaaatttagggactgggaaggaatgttgattaaaaaacaaaaacaaaaagaatcactgataaagtacatctatctcaaacgaggcagagaagtggatagctttgcagattgtattatttgaatgggagagaggtaggggaatcaaaataatagataacaaattcagtaccacgtagtaatagtgggttccttctcatttgtttgctaattgcttgagtaattcatcactggtcacttctaacaagaaagcaaggttcagtgggaagagacccttccttttctgccattctcaaagggaaataattctagactgtggctttcatgagaccttgtgtctttggtttttgggtggatccccaatggtcaaaacagtgcctacaagtgatcaattaatatttctggaataaatgaattaatgcatctgcaatgggtctcggtaagtaatgggtgctcagtcacatgctttatctaattaaatggcgactattatgcttaaatcagacaactggagtcaaaaagggtgaaggaaatataaagactgatagttagtggtgacacatagctgaaaagtattctctatgaagaatcagtgcacaaaagaaattgctgatgataacaatgcagtggcatttggagttttgttatgttcctggtgctgttctgagaagtccttacattttaacttatttaatatttgcaatgactgtgtgatctgttctattacatcttatttcaaagggaaaacctgaggtacatcaaaggttctagaatagaaaaggtggctcagatgaatcagaactgaggattaattgtaattcttatgatggaacagtgttgtggtggtttgaatgtaattggcccccataagctcatagggattagcactattaggaggtgtggccttgttgaagtaagtgtggccttgttggaggaagtgtgtcactgtggaagagggtttttgaggtttcccaggcccaagctatgcctggttcagttcacttccttttgcctgtgaatcaagatgtaggactgggagctccttctccagaactatgtctacctgcaaacctccatgttccgagatgataatatactgaacctctgaactgtaagccaccccaatataagttttcttttgtaagagttgctgtaatggtcacagtgtttcttcattgcaacacaccctaagggtgcacacaccctaaggcatgtgtcaattgctagtattctttagggaggctcagggaccttggtagccaataacttgtaggtagcgctccagctttgctattggttggggggcagtgaggagcatgggaggatgggagagagagggaactggggattgatatgtaaaataagattgtttctgaataaaaaaatataaaataaaaaagaagaatcattggccatgtgactcatatgtataaccttagcactttggagactgagacaaggccattactatgagtttgggcccagcctggacaacacagagaatttcaggccagttggggctaaataaaggaaagcaggtagaaaggaaagaagaaagaaaataagaagacagaaaaaaagacatctggagaagaatacaacgttggacaaaataaccatcctcttggataggtgcttattggcaatgtagaccggtaagtctccaataagaggcatacagaggcaagaggtgggggaaagtttgttatctttccttcaggtgcctgccattgactgggtctatgtatgagacagatttcttctaggtgacattcctgcattattatgacataatataactgccctataaacagaatgctaataaaacaccaacacattgcaccatctttgcttctggagatttttattgtatatcccgctaagagtgaactttgtttgaaccgcagtgaagagaggaaagtattttgacgttttcctttctgggcatttttttctttctttctttttctctccctctctctttttttgttatagtacataagaataattttttttcactacaacttggagtaccacataaagctaaggagaactggggatgacatgaaacctctggacctcaaaagagaaaggtgcattccaggctgatgaggacacaggcttggctgacttgaggaatactgaatggctcagatttttagaggataaatatctgtctgttatttctgtgaaagtgaacattttacagttggtatttccttatctttttccttatctaacaagtttgtaaacatatgttccaaatcagatgttgaagtttttgtgccttattttgtattaagaaaatttacttgtaaatactaaaagccagaaatagtactttttatattttactttttctttctaatgaggtataacttaagaaaatagaaatgaatgttggagagtcagaagcatgaacagtgagtcaaattaatgtcacctttgtcagaggcaccttgtgaaatccccttgttcagttctttattttgacacagtgactgcaaacagtgtggattgtgtacagtgtccctgaacactgtgtgacaactttacactgcctggggacttccattcttgtgtgtgtatgtatgtatgtatgtatgtatgtatgtatgtatgtatgtgcatggccattctttccttcaaataccacaaaatgcagtattttttcagattagataatatggataatacggataattttaaataccacctgggctacagcaaagcatattttccatgtttatttgttattacatgaatatttgactgcccattcataaatctttcctatatgtttgtttatgtgtgtcaaagaacttaaaggtctataaaaatagtgttttctgctcttcgaaatgttttaggatgtcaggttctatgggagtctttgtgcaataatgtccctgactttttcagcgtttatcacaaatgtaaatgaacagtctgtggtgtggcctgttttcagggttgatatgatgatcatgttgctatggcaatgatggagcatacaggttcatgagatggtattagtaagactgcagcttgaaacttaatcagcatgccgtgacttctttcccatatttcaatatcagtttggcaaattgaattccaggcagttgtcagtccaatgtattccctgtggtttctcctttgcaaaattgcctctttattctatgcactgatgatcatggagtaattgaaatgtgaagctgtttgtcatgctatttatacaaccctgtctggtagccagcaatctttgtgtggtgtgcactgcaggtaacaattagatctagaaaccttttcttggttgaacaagtgaatgattgttttcccaaaatactcctgattttgtgggtactttatgtgataccttattttgtgggggaaagttcagccaaggtttaatcacaggctattttgctggcgcaatagggtttgcattctctgctcacaggcctgtgaggcaaccagaacactgaaagagcttcactcctcagggaatgtgcccccagccttccagcaatgtgctctccagctgagtcagaaactggactctctggcttctggtggccccaaacatttgcaacaatagatgtgaaaacacaatttcgagtggaacagaaagcactgattggggtggggcaaggcccaggtgaggaagaatgctttcgctgtaggccgctttgttccgggaggatttaagccccttttctgtctccaagtgaactgatcaattacgaagccccccaccccgtgtatcccttttttgggttgttttgagggtcactacatgttttttttttttttttctcctgaaagtcaactctaagggaacataaacggagctttatttgaagcccagcaggtagaaatgtcccctccctcctcttccctgcacacattcactgaaatgaaagggagtagcggcccaccctactcctattgaagggagtgattgcactcagtgtgtttctcccactaaaataactgaaatagtggcgtgagaatcgaacggaggatctcctgtttttataaggtacaattatgaaatcactggagaagagctgattttcaaagctccagggggcatgcgttctgctcctctctcctggacccttccgtacttgtttctgctgtattctgccagtttcctagcatccacagcaatgatcctctttctgttaagtactccccgcggtgggcatcttctttttttcttgtgtcatctatactctctcctgggtcttcctgttgtggtatttagacattgacatcatctaggggtactttgtacattgtaagtgcctggaggtcaatctgtgacacatcttgttgatggcatcatggggtaccagctactttacggctgctggagagactgaaatggagtagtttgtgtctctactgcattgcatagctgatacaaatgcgaaagacactttgtatcatagtgtgaagtgtcagggtttagtttgaacttactgagaaagttgccgggtaagttgtcagggctcttctacagctagctattgatttctgggtgcagtgtgatcttgacctgcctaccagatggctgtatatattcacagaagagctaatgacacagctcaaactaaatagatgttagtggactggcgatagctgatgataccacgaatagctctttagcttgactaagatttattatttatttcctgcagggcttcattagcatctccctgcttcatccctttcagggatactttagttgaaatgcccgtgaagcacattccaagggcagagctttaactagtgcagagagtatgggaatttagaggctactcaaattcaaaataatgtttaaaaaagattgctacatttccatgtttacagcagatgcactcctcctgcttccaggaacaactgatcttaatacctacttagcaagaatgattggttaaaacaggaggctaccagatggctcagcatggttaataacgcccatctgagggctgcattgtgaattacaaagtcgagggcaaaatttaaggctccaggtggcaaaattaaaacaaaagatggtgtaattttttttatttaagaagaaaaggaacgaatgccaaattgcaaggtggaactactcttttgttatatgtgcagagttactaagttgaatagaatttgctgtaacttgacaaactgttaataggctggacttgttttaaaaaattgtggcctgaaccaggctgtagtggtgcaaatctttaatcccaatcctcaggaggcagagacaggaggatctctgagtttgaggccagcctggtctacagagcaaattccagaacagccagagctacaaggagaaactctgtcttgaaaaccaaaccaaccaaccagccagccaaccaaccaaccagtggcctgggtcataggcaggcttttcttttccctttttggtggaggatgagctgttaggacctaaactgcaaagtggtgcactaggaaggctgtaaggttatctttgtgtgtgtgtgtgtgtgtgtgtgtgtgtgtgtgtgtgtgttcgtgtgcccaggttttgatgatctcaggtaacttctgacctcaaaaaagggcaatgtttaatttaattgtaaggattctccagttcaggaattttctagattgcagtctgaggagagttcagagtttccttctttcttaatcctcaggacacttgggagcctgcacaaaccatttcttggaattcctagaggacactctgtcgagactgcctagaaccagtaaggaagacacaacgctgagactcttccttaagcagtttactcaggaaacttaaacaatcttctgaccctggggaaaaccggccctcaacttaaatggctcttgggtagccaaccccagcaagacacgtggcgaatgcccacagctacacaaacacacggaagtgaagccaagtctcgggctagcagaaagtggaagccggcaccatctttttaccacagagagcaagcttgtcatgcagctctctacagttcccccttttgtttttgcttaaaaatgcaaccggcaagagtagaggtctgatctctgtatttggagagaggggacaatgtactgagtctcgaccaggaatatgcttcccagtgatccccagaccagtccagtgcccttttttttttttacagaggcggggatttttgggcacaacccgagcgcaatcagacttgctctcctcagagtcgaacagagtgccccctgagtgcagtgcttcgcctcacatccggtgcaaaatgcctctatctctgagagctgcatgacaagcttgctctctgtggtaaaaagatggcgccggcttccgctttctgctagcctgagacttggcttcacttccgtgtgtttgtgtagctgtgggcattcgccacgtgtcttgctggggttggctacccaagagccatttaaattgagggtgggctttccctggagtcagaagattgtttaagtttcctgagtaaactgcttaaggaagagtctcagcgttgcgtcttccttgctggtcgagacagtcgtgacaagtggtggcccgtatggggaatttctcctctgaagagactcagaaccttctgcagcagtgcactggtaagtcccaggtaagagggataaaattaagggcctgtgaagagggcggagatctacggaccgcaactagagcagtgataaagttcggggggggggggttttggtgttttggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagcaccctggtttgcaaacactggacagcttacagtcccttcatgggaaaaattggggagggacctagattttgcttgggaacaggggacgctgaagctgggtgtccgttctatctggagataagtgagaggctgcctggaggacaagagatgcagtgaggcagttgaacagggacaggctgctcttgactcccttcaggaggagtgatccgaggaagctaacagtgagaaaatctacctgagtcttaaggaactggaggagacagagtcctccagttccgagggggacacagaggatgaagaggaactccaagcactaatagagcagctagagagaacctaaaaaaaaggataaaagggaaacgggagaagcccgagttcaaaaggtccctcgtgcttgaaaatgaaagggaaaccccagccgaaaccccatcctcgctgcctccttacaatatgacagaaggagatggtggaggcagtggcaaaggagcctcacactggctccctcaggtctggtgggaagttagctcagagttgcgccttgcttgcccggtattcttagactcacaggggcagaggtatcacgagcctttagactttaaaactatcaaggccctagcagagctggtgaggacttatggcattactgcatccttcactgtggctctggtcgagtcccttgccaggctttgtataacgcccaccaactggaccaacttagtacatgcctgtctcagcccaggacagtacctataatggaaggcgtttcttagtgagttttcagacaagcaagtggcagcaaaccgagttgccggaggtccagcggcagcctgggacaaagatatgctgctcggccaagggcaatttgttaaccaacaaacagtatacccgattcagttgtatgatcagattaatcagacttgccattagagcctggaaatctatacctaataagggtgaagtctctggctagcagaaagcggaagccggtgccatctttttaccacagagagcaagcttgtcacgcagctctctacaacactcaaacattcttcccctttcagagttgactagatcaggagccaatctactgattctcttctccacctggatcctcaactttctggcttggatcaggcctatccccatatttcttaaggttgttcttagattgccttttgggtttacaggaaaatgttgccaggctgcagcagtctgtgggatttaatttatagatgggcccacatcatcattttctgagttcttgctcatgcaacctctaaggaacttgacttcctaaagtttagaaggccatttcaggagtcccagaacagttgtgcacaaataaatccaacactgtctgtgtgtaggatacaggaaccttgagtttccattgcagtcactactaggaacattcacacattcaggagttctggccatggatggttccagagctctggtcatcagaatgtcagtggtgagaatactcagtcatttccagctctatgatgcatttgactcttaagcccaaactgagacattcacgtcaactttgagcactggtaaggtttgtatggctgttccattgggcagggctccttagcctccatccaacttctcatgaaattgaactcttggtcaggaacctcatgtcacaggtctcaggggactcttcagtgttccatctgtctcctgaaacagactgatgtctcttggtataatgtaccttgttccccaaatgagtctactttgttttcaaaaattcttttatctggtaacttagtattttcttttttgctttatgttttatgcaattaaaagtgttgtgggatcagttttcctaatctcttgttctccttgaaaagtaaatttaaagttcttctttggttttcagttttgagttctaccttccttttcagagacacagacacctcacaacagcatttaagtcatagcttgatctcttggctctgtgctttctcatctgtgacatctgaaagaatagagtgagacctctgtccccaagtgtaggaagaccctagtattccttccctctgatgtttgatgcttggcttcccaatcctttctacctggaatttgaatgacacatggattacctggatctaaaactcatgctcccttgagtctctttgaaccccaagaaggaagaaacaactgttgttgtggctggttttaggacaggctaagcccctgttatgtgcttaggtgtgttagcttcctaggctgtgatagcagggactgctaactatgatggtttattgtaacagagatgtattatcttatagtcctagaaaccagaagacaaaatttaatgcattagcagcgtggtactccctcctggactctgcacagaactctccgctgtccctttccagcttctggtcannnnnnnnnnnnnnnnnnnnnnnnnnntcctgctgtgttgctctctgagatcatgtagacttcttcccactttacctgggtcttataaaggccctaatcattagtaaattcaggcctgtgttgccagaatatgtataattttaattaattacacttgctgtaagctattttctttctttctttttcccccggttttttgagacagggtttctctatgcaacagtcctggctgtccaggaattcactctgtagaccaggctggcttcaaattcacagagagccttctgcctctgccttctgagtgctgggattaaagatgtgtatcacctctgctcctcataagtgggcatacattttcaaagtatattagattctaaacttctgagggtcagaactttgatgtagcttattggggccataagacaacttaacagtgagtgacccagaaggtcaggaggaatcaggatagcatgaccctcagaggaggacgtggtagtcaatggaatctgcaagagaatccactgagtcattgttagcaagacagtccaagaaggggctacatacaatgcatgcaaataggagcttctactttataggcccccattacactgagtggaaacaagagaactttaaagaacttcttttttcacatcctacagtatttatttctgtcatattctgaagagcaccttcctcttctcagtttctagcatctcagcagagtaaaaagtagaggatagcatccatggagaattaggcagagggcagggagtgtcatataacatccagagtgtctggcaatgggcaggagccttggagggactgagaacaggggtgagccaaaaagcaaattgcttttctactaacattttcttctccacaagctcatctcagtaaagatgtgtttcttgcatttataaatcataaggactttgcgcttgcacactattctgtggatgcctggtttgtctttctctcacagtacattttgagatagatcccaaaagtactatatagttaatatagagacacaaggggcctggcttttgctcctcattggtttgttagagatattatttatgtaaaagactccagaattaaagtcagagtaatagtacatgtttatgctacattgttatttttagttaagcctttaaagtgttaaaaatgcacacagagaatatgaaagcagaaatatgtatatatttgtatataccatatatgaatacatattatatatgtatatatttatataaagtgcatgtgtgtgtgtgtgtgtgtgtgtgtgtgtgtgtgtgtgtgtgtgtgtatgtgtagcaatctttccttcactctggctgtacgtgttcattcttatttttgtcttaactggtaattcaggaagcttcttgtacatttagccctggcctttacttatgttgtctccatgcccctttactggtcagtatgattgttgtgatactgttctatgggaataaaatgataacatgaccagtctgacaatctcgatcaagagcttaaagaagtgatcaggtttaggagcagaatctgagccatacagaggagctcctggctgaattctgatcaccaggcaggctgcatgctccttggcacttctggcataaagatgcatgggatctaaaacagagttggaagaactatctggtgtatgacgtttgtttccttatcagaaacatgtgaagaactggacaggaagttgtccttgttgatgggaacatacatagtccaggatatagatagtccttattaaaatgtcacccacatgcctcagccctcccaagaacactaatgctggaagaggtctgcttcagaaatcccgagccacacaattactcctctcagccctataacccagttggtttcaaaccataaacttcctgagggtttttgttcttgcagtgtggacccccagtgaaaaggtgctaggaaagattattgcagcctggtctatgagaagcccatcgagtgagaggggagaaaatataagtagatgttataaaatatgctgtgtgctgctaatgatcaacttttgctctcagtgttcctgaatgttcaaggaaagaaagagagctcagaggaaaggagtttattgtaaaagaacaattgcccagtacattacacagcacagcagggttataatgagcacgtgaaagcacggtatctaaccaacccttagagttactggaacagtttgatccaacttttacagacaaaatgctgaacagccagatcatttcgcccaaaggattggactgcaattgttttgaaagtttcttggaagaaatgcaattagtgacaagatttaataaagccaaaacaactgaatgtaatcagacgagcctctattcttttctgttccttctgtataatgtaagaaaatagcaaggaaatgattacattactaaatgaattaaacaaagctccaaaacataaattagaatttaactacaccattaaaagctaatttaatttgcaagccatcattactagatagtaaagagccattgcaaaatgtacaatacctcatgatcatggggaaaaaaaaacaagcaataaatctcattgagcggatgagtttccgttacattagcagatgaaagtgctgaatgggtgtttagcatggagtgggaactagctaggaatataacaattggtttgttttatttctttttccataaatggttttatagttaaaggaagcatcagaggtagctagggaagcactcaagggttctcagtgtatctcagtgtagtacaacctgggcaaagagaggcatggaaattttttttttttttttttttttttttgtcagaagccagctcctccattcaagtataaacaatgacttgttttatgtaattgtgaatctgatggcaaatccagctttttttcctgttgtgtttcttattaacttgtgctggaaataacaagacatgcataaaaaaattcaagacgtgaatgaaaacttttagttctggggtattttaaagcttaataagaaaatatttaaaaaaatttcaatatctgattagaataagatgcgaatgagtttcaaaattttttctgtcttagaaatgagctttaaatgtatgattcccaacaaaatagctaataataaacattttttctttacctgtccaatcactgttggacaaacaaagagtgacgcgtgggctaccagcagatggcagtataatcccattttttccttttagcccagtgaacacaggaatctgaaaatacaggattttccccccacagtgttaatgtaaggcgaagctgaaaactgctataactccctggttatgccatccttctcaatggtaggcaacaactccacgaagtgatggggcttcatcatatcaacacagtgattctctcctacagatgtttgctaatagcataggaattcttccaagagtgctttttattaaatcgcttgctgatttgacacatactcatttctgttttacacgttgtcatgaagttttaatgtctgaaagcgttaacacgtagtttaagtgtcatctcatctgtgtactgttctctgaattcccactcgagtttgtgtgcacatatttgtggacatgcagaggcccgggaacaaccttgggtgttgttacccaggaagccttagcagtttttgagacaggatctctcattggactggaattcactaagtacattaaggctggttgcccagcaagccccttggtcctttattgcctcaccattgctgggtttacaagtggatgccacaacatctggtttattttctatgtgggtcaagagatcaaattcagatgagccctttactggctgaaccatctcccaagcctcctggtagatctattctcttaagagccagataataatatcttctactttaccttgagattttcttacatctagtgtctcactaggctgtgagctctacaaaggatgcattctattttagcccaagattacctgatactggatccagggtgactttgtagctccccttttgtagttttcggatttatttatttttagttatgtgtatgtgtgtgcacctgtgcaaatttatgtgtgccacaggcattcacgagcctgtgggggcctgatgccccagacctggaggagtttgtgagcctcctgatgtgggtactggggaccagacctcattaggtcctctgaaagagcagtgagcacctggaactgatgagcccctctcaagcccctgcagttactcttaaggatttgtcgaactaacttatctggaagatttgaggaagaatatttcagcacatggctccattttacagagcagctaagtggtacatttgagaagaatattgaaatcatggcattagaaaataaagccaagatctttcaacaataatttttgctgagcatataaatcagaaacttcactgacttgtaattaatagagagtaatctgctgagatttgcatctctcccattggggccaacctctaacatagcaactttttcattaccaagaacgaaaaatttcagacctaatgaaatagcaggaaagacaggatgtcaatatgagggtgaaatgaacctttaaatgtagaattatcaataaatgtattattgatttcaggagagtagtcatagatacagtcatttatttgtgaagctacttactttgtgtcaatgactgattgcagaagtgagcaaggactatatttcagtttagaattttggatgcaagagatgaaataactatccaaatgacctgtggactaggtttctgcacttacattacttttaacatcttggcatttttatagcattattactaaataacatcttaaagtttccacattgaaaggctccatctataaactctttttgatatgaaagccttctctcagtcggagactttgagttggagagcatctgtccaccacatctcaagtttgcttggctttatctctgaatttactggctcatgttgactccaagcttctcctgttcgtgactgtgccaacatccacttagaacagtggttctcaacctgtgggtcacaaccctctgtggggtagaatgatcctttcacaggggtcacctaagaccttgggaaaacacagatacattatagttcataacagtaacaaaattaaagttatatataaagcagtagcaaaaatcattttatggttgggggtcactaacgcatggaggaactgtattaaagggccatagcctagcaccaatttgggactctcacatctttagaggagatggtttcttcctggaagtcagagactgtggtgtggattacaaggttctgggtgccttattggaggctgtgattgcctgtcattgaggctgtgtgttcatacaccccacatgtgatgccagtcatagtcttggttaatgtctttctttggctttagtataattcatgaaaggagagaggctgctgaagatgaagtatgctacaagccataaaatcacacagtaattatacagctatcatatcatgggacagactactcagaggaactaagagttctccggatgtataagccaatacaaaagttgtatttggcattatagtcttgtgaatgaatcagctatttcttgctgtagattcttcctgtagcatattccttactgtaacaaacttggcatttacttcccacagtttggcattatctggtcatttactgggaataatttctcccatgcatttggggtttctctgtgtagctttggagcctatcctggcactcactctggagaccaggctggcctggaactcacagagatccgcctgcctctgtgtcccgaatgctgggattaaaggcgtgtgccaccaacgcccagcgacaccagattttgtttcttgtgcaaattaaacttagaccctctccttaacccacagcttaaacatttgatgctaaaagtttctcctgccagttttagtttattgctctgtgttttggccctgagaaactcaagcctcacattgcattgtgaaatgaattactgttgcaaatatatatgaacctgtacccacaagaactgagaagaaacgtagagagacagagaaaggaagaaacagaggagaacaagaagaataaaggaacatgcagaggagcatttgtgtctgagccaatccttttttccctcagattttatttccttcacttatttgtagttcctttttttgagtcctgagcaaaaactttagaagtaaaggccttttaaagttttctatataagtagatgcagatggagctcctgaatctgaaagcactgtagaagacattcctagtgacttgtgctaatgcaagactgggtcacattgtacaaaaacccatttaaaagagaggacaaagaaagcacctgaaggagttttacatcatgggtgaaccagatgctctagaaatgaagatactcatttctgcctgttatggtaggatcaaatgagtaatggaaattaaaaatgctttacatatgaatgtagatatcagagcataaaaattactatatctaattaggagttcaggcttttggaataaactaaacaaactctatccccttttgctggtgcgaatgcagactggaacagtcattatggaaatcaatatggctgttcctcagaaaattgggaaccaatctatggcaagaccactataccattatatcactcctgggtatatattcaaaggacctgcctctctaccacaaggacatttgctcagctatattcactgtagccttattcataataatcagaaactggacacagcctaaatgtcccccaagaaaataatggataaagaaaatgtgatacatttacacaatggagtattactcagctgttaaaaaaatagtgacatcatgaaatttgcaggaaaatggatggaactagaaaaaatcatcctgggtgaggtaactcagatccagaaagacaaatgtggtatgcattcacttgtaagtgtgtattagttgttaagtaaatgataatcaagctacaatccacagacccagataggttaggtaaagaggggggctgtatgtgggacaaatggacctcactgggaaggagaaatagattttgagggcagactgggagcaggtgtggatgggagcagcggcaggggtaggatgtgtgtatgggggaatcatgagtagggagaggatgggggagagactaggagagatggctggattagggaacatttgggggtgagggtgtgtaaatctagttcagaggaaacttcatggaatatatgaatgtgatcctagtgaggactcctgctaatggaggatacagagtctgaatgggccgtctcttgtagctaagaaaagcttccagtggtgagactgtgttacatttggttgaggtgttggtcaagggggtcctatggaaatccccaaactatccatgcaggtgataggaagaaggttgccctctgcacactgatgggggtgggaggacattaccaaggacaacacttatacagcccattgaacatagagaggtggagccttctcacccctgtgttctagtttctttgctgtgagaaggtactctgcaggctactgaaagagaaacctggacaccaacccagccacaaaacctttgacctgcctccagtctgtcctgctggcaagatgttctaggacaatggtggcatagaacttgggggagtagccaaccaatgtctgatttaatttgaggcccactccacaagaggattcacccggatgaccaggaaccagagactggatgacccagagacctagagtagaatctaacaggacttgccaaacaagcaaacaaacaaaaaaaccaaaaaccaaaaaccaaaccaaaaaacagaaacaaaaaaacaagatatttgtcatcagagaggcttcctctggcagcagaaaggagcagatgcagagacccatgccagacattatgcagagaaagcaagtataaattggaggtctccattgggtttcccccttgcagctcaagaaatcccatggtagagggcttgtaaagattgtaggagtcagagggcatggaggacaccaggagaacatggcccgctgaatcaagtaagcagggctcacagagactcaagcagcaagcacaggtcctgcatgggtctgcaccaggtcctctgcctatgtgttatagatgtagcttcttgttttgcggggactccaaacagtgggtgtgggtgtgtctgattcatttgtctgctcttcagactcttttcctccttttaggtttccctgtctagctttgatatgagggcttttgccttgtctaattgtgttttgtcttttcccatttagttgctgtatcttagaggagatggaaggggagtggatctgggagggaaaggggagatgggataaagctggcaggagtggaaaaaggggaaacgtggtcagtaggtatatattatatgacagaagaatctattttttaaaaaaagattctaggaactatgattctgatagagaatcaaaggtcatgtcacatggcaacaatgaaacatttcctgaggcttcatccttttatagaaaacaaaacagattatgcagagctaaaaccaatgtgatgggactgtgttcatagatcctttttgtatgattgcctatcagaagattgtgggtggcttgtgagagggttaggtacacttagttggacatagttttcttttctttttggtcttcatggttgtcgatagcagggcatgcttattaatccagaggttcttacttgctttttttctttaacactaactcccagtggaaatcccgtgttggcatccatttattcctagcagggcattctgcatccaggcagtggtatttagcagacgccctactctttcttcatcctggtggtatactgccattgctcttcacagagttaaactgtagtagggaaatacaaaaagaaagctcaaagatgctgtcttgtgtggaacataatacacgcttacaacaaactgagcttgataaaataccagcagcagggagcacagctagttattgcttcaagggaaaatcaagtaaaatagctacaaattgtttaaagtacattcctcccatctttcttagagtttcagtcatttttttctttgaaatagaaaagaccttagtaatttcctaagtcaagattagccttccttggtgtgcagtgcctgctctggcttcaactgaaggaatgaatttaattcaaaccctgagagtaattactgtagaaccaccatagaatacaagtagaaagcccagagtgtgccacctggtgcctgcaccccagggggctgaagcctgagactgctccttttaagactctcacatagcttttgctgttgtgcctcaggcatctatgaaccaaagtgctgggtactgtgctctcatttcataaattatattaatgaaatataaaagttgagtatcaagaaaacaaatttttgcaagtaccaagtcaagtagagaaagtgcatgtctttgaactttgaaccacttgaactgatacaacactgtagcattatactgttatcccaaaatggaaaggcttgtatgcaggagcaaacacttggcagagaaagcatgaatcctatggatcttccaaaaatactcagtgtctcacagatctgtcaggcttcaaagacttctaggaccatagggagtgtgttgtttgtatggttgaaggtttgacattttgtacattgtaaatgcttggacttggtgcagtcacagcaacatgtactattttctacaacccagctcagttctaaaaagaagaagattatcaaaagtagagaacagacataaacctatgtaaatgcttaagagtggcaatatttggagacaaaatatttgaacaaaaaatgtatgtatctacaagctgctgtgataatatcagcaaacaaagcatgctgcagattttacacaacccaattagtcctcaaataaatgtaagaagtagaaaataaagaacagaaaggacttctcttaagtctgattttggtatcagctgctagaaaatatgcagggttagaaacctcagacaaggagtgtggaccaatctggagaggttggtgctgcttcttcacaaggtcactgatgcaagaccttaacaagatctctccctccctccctccctgcctcctttcctccttctgtttcttgtcatcctcatcatatctcgttgtgatttgcatctccttgatgattcatgatgctgagtgtttttatgtggttattgtgtatttttatatatttgtagaaatgcccattcaagtcatttagctttctattagttggtttattttgttgttgaatgtagcagctcatttataatctggatattgttaccttatcagacacaatttatgaatgttttctctaattctgtaggttgccttttcattgtttttttttgatgatcaaatattttagattttgatatggctcatttcatctgtttttttttcttttattgtttgtgattttggcactatatctaagcattgccaattcctatgtcatgatgacatttgtctacattttatagttgtatctcctatatgtagatctctgatgcattttgaattaaaacttgttatgatgtggcataagagaccacttagtgaatattcagtttttccaagactgtggatataactctccctttctctgacaaatgataaaaattttgaagactggaatgtgcagagtagtgtgttcattttggtcataccctaagctgcatgatgagctctgagttggggcttaatttagctgaaaaaaaggcattattagcaggaaggggaaagtgcagctgtgtcttccttcattagcatctaccatatcaggcatagaaacttagagtcttttccactgatagagactttcgaattttctgatcaacaaaacactgacaatgaatgttacactttgaattattttctcataaaaatgtggttgctcataatttagaacttggaaaacacagagttgtattaaaaaaacaaaaaaaacccaaattttttatttattccacaatcttgatgttactgctactaattctggctgcttctaagcctaattttataaacatacatatttttaataagtaggaataatgttgaattgtaaggttttttgccctggtatttcttgtgtttcatttgggacgatgctgtgaacccatttccttgccattttaatgaagcttaaaggatgcttgagggtgtggcaaaggcgggcaggaggaccgtttcttatcttggcaacagtacagacttgtatgacctttaccaacagttaatcacaggaacactttcacctcctgaaagcttgaatgatgcttgctatccaggctaagtgttcctgatgaagagcaccgaggtaccatctacacaacccttcttcccccattagaaaggtgctatgcatgtgaagattaaatgctgtaatggacccttgttataggccaaaagtagatgaggttagaatgcctttctttccctttccatcacccactcattcatcctatgtcagagggcttattggcttgctttctacacaaggccttactcacagaccacagcagtattgtgtctccacaattgaagagttgatagcattgaaggcagttgttctagatgacttgattagtgagttatgaacataaacatcatcatgaccaggtagaaacatctctactgcagcatctattcctttagctatatttatcattgttctttaagtctattgtggctgctgctactcttggtacagggtttctaatgtgtgagttagtgtggctgtgtgacccactgaacttcacaccctccctaatcaatgtgtgtcactcctttagagtctgtttgctatctgcctttggatggcaacggacaagatgtttgttttagcctttcttctgattatagagttgcagtgttatctattctagtggcctagtacactatgtctgtagtgatatagttcagagcatatttatgaagtaatttctttgggagaacttgtttacattactcagtttgagattcagtttttttttgtgtgtgtgtttgtttttggcttcactgctgctgaggtttggagatgaggtatcttcccaaaagactcacactttgaaagcttggactccagagactggtgctcttgagggctgtcttcatgcatacattaagcccccaaggagccatgtgataggaagtgtgtctggacctgctctgtactatctcccatgattccttttgctttcaagcctatcatgaggttgtcaggtcctccacatctttccatttaaatgttctgcctcatgacccagaaacaatggtacagctggatggtgaactgaaatctctttaaccacagaaaattaaattgtatgcttgttaacttattcatccaaggtatttgttgcagcaactcaaagcacaaagggaactgcaaactgcaaacttcagtgtgctgctgccttttccaagcagtaacagaataatttctctataaatctttatctgacttagaagacagtagactttcttctaacaacctctgcatctagtgaagtttggagtgtccttatagaattaagaaattgttttcattgtgtctatgtactggcactgtgtgaatattttcatagaaatatgcagtatatttcaagcccaccctggtaaccctattattactccccacttcatgccccttcctcccatcagtcccctttctttccttagagagtttcacttcatatcatgtgcacttatgatttttatatgtctataaaatctgacaattacaatgaattaaacatatgacatatgtgtttctgagattggttaaacttgtttaatgtgactatcccattacatcaatttccccacaaacatcatagcttcttttcttttatgtcttctatttggcatatatatcacttttttgtatccatttccctgttgttgaatacacagtttgccttcataacttacctgctgtaaattgttctgtgtctattttcactgtctttacatatttttgccatattttaaacaacctggagtgtagggattacatgtgtttagttaaaatatgagagcatacagtctttgaagtacttaagctgtgccccttgggccccaatctagatgctgaagaactgcctactccacctgggtctctatccatctgcagagggagaggttagcaaatgactccatggaggaaaggagaaatcagtgaccagactgcagccaagaaatggcgtgtgttaacttcacacttcatcttcttcgagcgtctgggatgtgcctgaagattcttgcctttccagtttctatgtgtattgcatctgaaactgcaccctgggtggtcagcaagggttttaggtcttacactgttctccagatcaaacagtttgcttctgccatgaaggcctgtaaattctcactcctggggcctgggccttgagtacctagaaaagtatacccaaaatatcaagaatccttgcaagagaatttctgagtctatgtctttgctttttatttttactgtatttcatctgtgcattttgaaagtgccttccctgcctggttttattaatctctcacctcttctgtgaggacaggagtgagctgtttatctccattttacagatgtgcagactgagtgacaggtggtgcccagggcagctttcaggcgtctggtttgcagcatctaatcatgagcatggctcctctcctgcccttctgctcgatgttattttcaatttgctttctcatctggagagggcattttcatcttttatgatagtttcgagtttcatttacaccatcagacctctaaattctttttgttctgttgaaagcctggtcaggatgacatccgtctccttttcagggtgggggcataatttaatagatagaaattgctggttccaaaaggaatgattttctttgcttttaaccctctttagttcagcctagacttagaattagattaaaatgactgataatatctttgatagcaccatttaaaattgtaataccacacccaactcattttacctgctagtgctgctttcaaacacataagcatagattaacgcatgctagaagctcagttggaagttaggagcttgttcacagacctttttgttgctgttgttaacctatgctcagcaaaactaaaattgagtttctcttccccatgtgccaaattacaggtcctaagttctactaacttgtccttcttgctctttgtgttgccttatgtttttatttttgttgtcactgatgtttcttattaaaaactgaagcctacttgcagtttagcagacactatgtgctgtgtgtatgacaaactcagcaaagagaaccctgtagccacttttatgacttgttcacacgtgtgtgctaaacacacaatggagagaatgggcactttgtctggtttggataaagaaagccagtgacaacaaagtgggcattagagagcaattcctctgatactgttcaggggccaaaagggtgagccactgagacttcactgatagtcacagtgggaaagctccaagtttaaatgtgatgttttagagtaccatcataagaggaaatgatcatctagatacataaacaaaggaatcgggccaaccagggcaggcacaactttcaatgattctcttaactgatgaacaaatacagaatcatattcttgccagcatggtgctaggagttggggctccaagtccagattactgtcacacagagaagatggccagggaaaatagtgcacacctttaatcccagcactgtggaggcagaagcagttggatttttatgagttccatgccagcctggtctacctagtgagtcccaaaacagtcagagctatgtagtgagaccctgcctcaaaaaaaacaataataataataataataataataataataataataaacagacaaggaatgatcagagttcaagatgatcttacagagaaagcaaagtgttttgtattttagatctgttttaactagttaattaactcatcaatcaaatttgaaacaatattgtatagtcctggccagccttgaactcttggttttactatctctacttcccaagaactgagactacagacaggaatgtgtcaccacgccaggcttgtgttttcatcctccatttgcaagtcccaatcgtgaaaagtcctggtagcttccctgtatgtgtcttgttatctctgtgtcataaaccagacatctgaggccccagagggccaataccatgcctgagactgtctatccaatgagcacatcatcccttgttcagcacagctctaaaggtcctgctcctgacactgttccacaaggaggtctcagggtaccaggagttcatcaggcggatgaagaacagaaggaggggatcccatgaaagagacattctagagcatgggatgttggggagacaatgcgagactcttccttagaagataggccactggggacactgttgtgagcatgactgccttgagagtctttgtcattaatgaagggaatttagtttcccttccagccagttcatattagttaggaaattatcactggcctgagggattttacatgtttcatttatttgctaaatattatcacataccttatcttagccaagttttacacaggtaatgaggtcagcagcatagaagaacccccacactatgaagaggaaattaaatgccaaacagtgctgagtggtgtcaataatccttagtagcatgagacaaagtcagacttagaaaactgaaaaggatagtgtggcttacatggggaggccaggaaaggccttggcaaggagctggtgcctgggcaaaactgtgtggtagaaagacatagacttgtatgcaggaagccacagaaagggcagtatagggcagatactctgagaggaacaaagaactgctcatatgctagacagtattcaaaatatagcccagaacatcttaggtatcaatttcattgatgagggaaaaccgagaagaggtaggcttttctaatgattcaaatttatctttacccgaatccatgcctgtgctctgcctgccctaaatgtgtagactgaatccttgtgaaatgaagacagaagtagttttggtaagattttgaaatagggcaaatagaaaatcgaatgggaatcaaagccagaaaaaaagaaatcatcaagaatatgcagtttgcctgagaggaagttgcttaagtttggcctgggagtgcacttgcaactgttctgagaggagtgaagagagacattcgtgccccttccctttggttatcagattatcttggcagtgatctccaagacagtggaattttcacaggagtcttgcacagggtgaaagctgaagtctggtgacagccagaggaggaagaaatttcacacagtctgacacacaatctgatcacctttcatgagagaccagaactcagagaacactcggttagctatgggcagggcacttacaccaggactgcctacacaagcaccctggctctctgcctaaacccaaatctcacaccaggagctcctaggtggactgtcgacttatgggatctcagttttgttgaggacagatggggcagggatgttagggttcccagaacccaggatcccaacataactactgtggaaacataccacaggaagaggtacagccaggaatgtgagcatcctgttcggatctgaagaattccgcagaggagcccattgggagtgaggagagagcctctggaggtatttgagggagcagcttatccaaaggctagaaaacttgccgggaatttgtgattcgtagtctctggtggtggctttgttagacttaatagaatgtggagctttcactcagccttatccacactcactttgagtggacctagccttgaggcagccatgtcagagagatggacttggatattgctttgcatgtaagtttggctgtgtcaagtctcaactgattccttgagaaatgacattgtctcagatgtcacagttcaggatggaggtagtgctttggatgtattctatctggtggaaccaaccccccacaaattgacaagatgctgagtggatgaggggttggaggctagaaaggttggctttacagcaagcagccagggggatgccattcacaagagaagaaagagcacaactaaattcacctttgctctcagttggagagcagattatattcttcacagcaaagtgatggctaaagccacccgcagtggagagaaaatagtccaggaaggctctttaaggaacaactcaatggtgtcaggagaaacctatacattctatcatgaagccattgagggtcagactcctagagtgccttcaggcattcttcttgtggccttttgtgtaatgtgccctttctgtgctttctatctgtatttcccctcctgtgcattatagatcctagtccctatgtatcaagttgctatatgccaaaggctactgtcaaaatatgtttgaacctcatctttcagttccttttccccctgctcagcgacattgttttacaataaattccaatgcaggagttcaatctatgaacgggcattggaaagaaatctaccagctttagaaactgaaaacttttgtgttaatgtgaattttcagggaagcagtcaagaaattctcaatgagtttagtgcccagggaagattaaacatgccttacttctcttggaatccatcttccttccgccatttcccctccttcccttcccttcttttcctttcccactcctctcctacgttctcccctccctccctccctccctccttccctccttcccttctattcccttctcattcttcttaccatgccagtaaaaacaggaagataataatctctaagtactggtttagggctcttgaaagggtgaagagcctgtgtcttctctgactagcaaggggagtaaaattgtcctccatttcccccctctattgctggctacttttatgaggtaaattgttctctcattaatctactgacacctggctttccttagctggacccccaaacacacttttaaacaagtgttagataatggattctatgaaatctgctttgatcagacttaacttaaggaactatcatctaataagcagtaccttgcaaagtattctcaccaagaggaaatgtgagggagatgaccacagattttatcatgtttgtatttgtgagcaaaggatgaaacactcacaaatgatctcaatagctaaacaggcctaaaaggcctactcatttgaaattctctctttgaattgtttctgtggtagacatctgtgtatagtgggaaattaccaatacggagtcaggtagaaatataagggtagttaatagggaaaagccttacttacagagcgacctagccagcagcgtggcagcagtctgtccagcaagtaccaaagtgaaaccgaaagagaaaacacagtcactctacatcaccctgaccatgccctcacaagcgtggtcaggcacatctgtagccagccctaagtaggcatggctatagcttcccctacaatttcccttttagtctaaaagaggattaaaacttaacagtgtaaagtatccaaaattaataatcataaaggtaaaatatcagaagatacaacaatctgcttatgtcacatcctaactatctatgttaactaaaccctaaagtgttctgaaagaggtgtccaagcctgaacacctccttccaatcccaaccataaacaataggaagctatccctaactaggtatatacactatcccaagtgacaacaatgggggaagggggcatagcatcctccaagttactttctgctgaaatgggatgacgacagccttgtggggtcatgtaggaagaaactgttagtatagtgaaagtcttgaatggattgtatccagtctatgctagatgggattcacttgattgaagatatcgctgcttcccctacatctgtgattatatatacttcagctcctaatagagaaactaaaaactcttcaaaaacaaaattacattttcattcaaagcatattttctgtttaatagatgatggtcccttaagctaagtttgaatccatggaagcaacaccctcctcctggaacagttactcttttggctcacctggttcacaattcacacttctttacagtttctttagttccttcatgatggatggaactggagaatatggtagtaagtgaagtaacccaggttcagaaaggtaatcaccatatgttctcttttatgtgtagcctagctgtgtggttatagaacctgaaaccagagagaggacaacaagggaggacacacaggatggggtggagagggtggtggaatacacgtgagagtgagtcaaaagcagaaagtgtatacagtggttgaaatgggtgcaagcagagaaggcatcagggagatagggagaagggctggacctaccataactgtgtgtgaaaatgctgttgggcagcctattcctttgtgtgtcagtttaaaaggacaaatgcagaacaccccacacctccttatctcccttgtccctttgtgtaaagttacagccagtgttgtgggtattccattccaagtattcagaacactaggtttcacactgaacattcaaggaaattacttgggacccacaccttctcaaaggttttcttttgtgatcttctacatttattagactaatatattcaggcttttccagaactgaaaggtgaaaatctccatctgttcatgagtctattctgcctgtcattattagcattaaaggtattttcttcattgtactgaccagatgtcttcatcatacagtgtaagcacattctgccatcctactgtattttgctttgaggtcagcaaggcagccaaaatcaatactaatgctgagccattgatatactacaagtcccttcctctcatgcccttctgctgtcactcaatagttgccaatggcttccctcgcctgtctaggtcattagccacttcagcagcccattccttctggttcagagtgtgccttctcacagtgtgtttctctcacaggaggatacgttcctcttaaagagactcatgtctagaaccagagatcctttaaaaactacatgtcagtggccacagaatagaattttacctcttagggggggggagaagagaacaacagtaaaaacaaacaaacaaacaaacaaacaaaaatacctcaaaatgcacagtaccttcacttgtactttcacaagagcacggcactggacagatttacatctagcccagcctctgatgtgcctttgtcactggggaccccagggaagccagttaaatgtttgttttcctggaatcctcatgggaatttcttagatggctgcaatgtgtcaacacagaaacaatgcatttgagagcttgtaaagaggagtttaatgcttgctgacagaaagtgagaaagaagagcccctttcccgacttagaaaagtgttttttccagaatttatcaaatattataaggcccaagacgctaggaaaacttggctgtctcatttagacacagcaatcttaaaataatagctctgaaactgagtcaggaggtccatcagttctcttgtagggtgtaattaatgaggaaactgtgaagtttcttgtgttgcttcttccccttctttaaatacttctagagatttaaggagtaaaagactagactttccaggggtctgtgtcactgagactattatggattttcaacattagacattgcacaatgtcctgtcattgcaacaataaggaacaaaggttccatttggtccacggtttcagaggttgtgcttcctgattggttggtcctgtagctttgggcagggtatcatggtggagagtgttgtgataaagctgctcttgcctttctcacttttcctttcttgacatgccagggtctcaatggccatttcaaaagccccgccccccatgacctctcgctaaggcccaacttttaaagtttccaccacatcccaatagaaccaaagcctttgggagaattgaatatggaggccatgaaggaactacattctttgctttggatttcatgatttttaaattcagctcattgcttgtaattttcttttctgagtgtggcttagaatatatgcaatctggcacactcaatttgccctaaagaatagtgcccactgtgcaaaattataccgcatccatcatcagtcactttactctgacttcatcaaaatcaaatggctggatgtctaactacctctgaatttagagaaatcacaatgaatgataaaggatggcttaaataatttagctgtaggtaattttggatgatgggtatgctatctgcaaacttaaattcttaagttaattctgatgggaaaagcactatcacatgaatcccagagttggtgaattagaaagtcaaaattaaaagaagtgatagaggaccagaggtgactgaggagccagtggagatccaggaaggagaccagcagtattccctcaggcatgggtaggttaaggtctgcctgtggttttaatgagagccagattaccaaactctctggagatgacaggtgagaagaccttttacaaagtcttctactaagtttcctaccagtgtggcaaggatcttaggaaggaattaaagaattcttcacagacagcaggagtagagtacctaaagtttttgtgagctggtgccttcctggagacagtccatctgagcttcaggtctatatttagttttgggggagagttctgctttaggatgaaagtgaggttctgaaagaatgatgtcctcaaatgagtgcaagtcccttgtcctcctattggtcaacagcttaagacaaaaccaacagaaatactcagatgcaatgatgtccctccatcacaagtaatcaaaaactgaaggaaaatttactattatataaaatattgcccagatgcttgtacattctacatatgcaaccaactaggaaatgtacagccgttttcataaatcttgtaatgtaaacagggaagcagatatgagcaggtacgtatagagcagcatagcaaaaggtatgccaagggaattagctgtacagatccttgtgagcaaggaaggaaagctaccattctattcagatgtgaggttgtggaaggcttcttgcagaaggtgacacagatatctgaaatatgaaaagaacttggagaatgccctagcaaagaacatgttcaaagcttgggaatttttggaacagatatgctgtgtgactcagtcggactgaatgacaactggggtcatggtgttgatggctgagaaggaggcagctacagtaatgggtagtactcacacatctaagtctgattattattagagaaggctggaggctggatttttatccccatgcaacagactgatattgaaagggttaaggtggtcacttgtcattatatttattttggaaatatctaccaactcactaattagcatgcaacaagagtccaagttctcagcatcttaactgccagggatcatggtgcatgcatagacttacatagagaataaatacaaatggatttgtacctttattatactattttatatgatagtccttctggctaaaaacaacagaaatattccattgaatatccatagaaaatgatatcaaggaagtaaattttttagaagccaaaaaccatgtgaaaatcagggtgctgagagaaaagtggatccataagggcagctttcaagctgagggtgtttgcccaatctagctgcccagaccttttgttgtcatttctccatgaggcatggaaaatgtgaggacacgtgtaagggactctcaaatactgggtcccaaagagagagtgtaggtaaaatgcaagtccaagatccctgtacccctagaatgaacataacaaaaactagacataatattcattgtcttatgatagcctagagagttgctaatttcatgcctttttaggattaatagacacagggtaggtaaagaagtaggagtttgatgtatttttggaaagggaaataagctgatgcaaactcctccctggaggactctgtcctcaactctatcctcaaatagctgcatggatattcttaggaatgtgacatcacagctcagatccccaagtacgcaaggaaagaaaacaagacagtgagaaccatcagaaataatagacagcagggtcaagttcaaaagccttcagctaggggcagtgctagagaacagagagcaaatgaatttactgtgttggtggaaaataaaatatagggtgctggggagatggcttggtgattaagagtttgtactgttcctacaaacaattggagtttgattcccagcagccacatctatctagtggcccacagctgcctataactctgaggaatctgatgccctcttctggcccctgggccctctgcactcgcatgcactgatcattcttccacatgcatctaggtaaaacagtaaaaatatactaaaacagaatatttaaaaatgaaacagaggtatggcaataaacatgaccaagcagatatgaaagtgatagtatttctaaactacaaaagtttaaaataaaaaattaaatggacagttttagcaggatgttggaaacagttggaaacaacttatgaagaaattagcaagttggatgtcaatgaggaggcctccgcactctagggggcccttggtagtggatacttaaaaaaagatacaacttaataaattacccagaatgcaatgccaagagatagaaatgaaaaatatgaaagggatttggagaactcagaagagagtgggtgtgtaggacacatctgctcagaattctgtaaataaaaatatatttcaagaaacagcaacactaagctcacagaaacctaatgaatctacctagaaatcatcaatctttagggcaaaaggcaaagcgaatattctatatctagtaatcagggtttgctctgatcaaatctgtccataaactttttcttacagagatttcaatattactacagtaactagttgggactaatttaaataacactaggtacagctttgggtctacttcatgaattcatttatacttaattaagtattttacttctcattgtgttttattttcagcgtttggctatgtagagacagaatcttagaatgaaccctcagaatggaaagctcccatgaggttgttcagccccattcttactttctttgctgttgaggagtggaaatagagaccatagaatctcttggtggctacagactttcagtctcaaccctatctaagtctagatgactcattggtgaccaatgagactgatggaacttacaacaggtgaaatattctctgatgaatcattgttggtaaaacctaaaattggaatagttatttctgcctaggaatttcaagggctcagaaggagagcccttttttcacaaagtgcattttgcttagccacttatgagtaacacctaatgtaaagactggttgcagggctggagagatggctcagcagttaaggagacttgttgatcttgcagatgactcagcttggatccccagcacccatatctgtaatttccattccagggaacacaatgcctccttttgaccttgcaggcacaaagatacataagatgtgtattatgtagatctatatgcagacaaaacacttgtatataaaatggaatcagtaagtctaataaaaaaataagactgctattacaattccagggcatgatttttgatataagaaaaaaaaagatgttttattttcttccatttcttccaaaagaaatgatttttttttgcagatatagctagggcttatagtcccagaattctggaagctgaggcaggggttcaagaccagcctgatctatataatgtttaggttctagaccagcctgtgcttctaagtgaaatcctgtccccccaaacaaacagatgaaaaaaaatcaagagaaacacctgatatctctactcagaattaagcaattgtatgtccagtccagctggtcatgcatgtgctgtggtaaaatttttcttctatgtctgtcttaattaatagcggtaatgttaatacaatattaatactttcactttctcatcctcccacccacgttgtattttctcagaatcctaaaactgcccatattgatattgtatgtgtttttatatatattcagtatatactgcacataatatgtataatagctatacttactttcagaaatttctagtgtttcactttaatatattaaccatcttcatggcttcacataagaaaggaagcgcttctatgtggcaagacatgctgcactggcgagaaatcataaagctcagaaggaactagggactgctgctctggtccaggtagctaaggagacttccctgtgtgaacttgaatcaaagaaaaaccacttcacacagttagctccatcctggcactttcctgcctgtcagcagctggaggaagcagaggattatttttcctgaactttcacacccacgtgttcccatcaagtccatcctgctagaacaaagagtagtaaagtgacttctgcagaaagtgggtgagaacccccaggcaagttgagctaggatcaaattcctgcctgcctggcatcaggatggagcccgactgttcccaaggaggcctctagatggcactgctgctcttccagacgatggctctctgttgatttctttcccttttaaatctcaccctctccctgatagttctcagctaggctgtgtgaggatttaaacaactctttgatgctgtaggatgttggtgttcacaagtcagctcgatccttttcttttttctttttttctaaaaagataatatagtgcttttttcaaagtcaattaacactcagggcaaaagaaatggggagagcaaaggtcactgtctaaagggtcgccttgaaccccgttggtattattcaggtgtcatccaggaattgcaaatcactgggcaaagaaaggaaataataattagttcactttgtttcctgataactcccagtaagatggcttaatatggcttttctgttgtattttctagtgatgtctgtggcgtgctgtgctcagagctggctgctaattctgtttcttgcagtcttgtaggcagtggggatgctctggggacaaattatgcatcaggaaaaggctgatgtaaagaatcagtaaaacgcttggatttcaatattgctggaatataatatatatatacagagatagagatagagatagagatagagagagagagagagagagagagagttgttcaggacgtgtggtattaagagaagcagaagtgatggactgaaggaccaaaactacaagtctcctttataatactgtcagcattggttccaaccaccagacaatgctaagtgagtcaaagcaggtggtgatgggggtggtggtgggtgccggcaacataaagattctcacgtgggacctcctccttagcctggcctctgaggctctttgaagccactgttctggagttaaggtgacatatgaatgccttagaacataacagtaccaggttttaataactttcttgaattccatttagaaaacaaatccagacactaaaaaacaataagtagatattaaaaaacaagcaaacacattgcaaatgagattattaataaattgatttttagatttattgctggcaacgtgctggattggacaggtcaagtgagagctgcaaatggcttacacgccccccccccacttcctgccttgcagttcaggctacagtcacagctctatctttttattttaatatataaagaccttcacttggtttaataacctttttccttcttgaataaagagtttctgtttgcaatcacactagtaaaaaaagacttgctccagaaactctgggagattattgcatgcctagctacaaaaataaggttttgaaagagcggaagggatggaataaatacataatgagaaaatttcttgggaggtgaattattattccagatttctgaactggtcttttaagaaagcaaataataataattacgttcctgcaaagatggttggcctgatgggagacaacagtagtttggctagaaatatgctgtggtgtttgtactttgctctgctcccacactgtaagcataaacatcgtaaaaccaggaaaagagccataggcaatggacaggccagtgcctcctggctcaggttctgggcatatttctaaccatgagtgatggatgtggtcacgtgtccctttcacctctgtgggtcagagtgaagtgtgaggctgcaggtagattaggggctgacagaagggttgattcgagctctggtgcctcatcattaggggtgttcctgttgaatgtgggtgtcatccaaacctccacaggtcacagctggcaatggaataattgaaattaatgaagaagcgaaggagaggtgagttcaagccagtgtccacaggtcggcgtctggtgctcagttcaactattcccatcaggatctttgacttcacaaagccttggcctttagcctcctccacagcttctcttgctatctaataggaccagctttagtactggctctaacccattaataatgacagatttatccgtgtggattcagttgaagaatttagctgtattttgtgaaataggttaaggatccgagctggaaagagcccttaggaagttacaacagaaggggtgccaggaggacaagtatacttctaccaccactagtggctctgggccaggaagggatagttaccggacactggaggctgtttgcacttttaacccactcctggtctgtcactctgtctctgctgccatgaagaatgccatagtgtgtcttctattctgtgaccacagcagcacattagttacatgttatataagactgttaccaaagtaagcctgggcctcctcttgtcaaagggtcaaatgacatctaatcccttcttcccctcagctcaatctctgcagatgtttcaatctaaaagtgaatattggggtagcagctcctgaagcagcagaggcagcgttgcccacctggactgtgggaagcaaaaggagttggccttatgagtcctggaccacctccagataataaatacagaggcttccggagaaaagtcctttttcttcacatgaattttttttttcctagcttgtttacccagtgttcaccatttaaaaacaatgcaccatctttattaaggagtctacttccaaaggctgcgttctcctgaaggagcctacacacctcggcaagctttcagacaacagtcacctagcaactgttttctcatacattaaatgatcccaaactcacatatttctctccatgagagctgtatattttactgtttctctccctcatacagtgtaaagaaagagtaatcaatgaagacattgcattcgtcttaatcataatatatcagttttaagccctgacttttaatatccaaatgttttcccaaatggttttctagtcactttgtgacccttttgagtgttctgatagtatttgggattagattccatcacaagggatagacgcaacccgatctggtgtctaccctccttcactggccaacttcagagtgtagtgtttatttcattggagctactggaggtccagattcagtatcttcatttcaggcatcaaaaagaagcaaagagatgtaaaagggtgtgtgcactccctttagggtggcctcccaggcgtctcactagttacttctatccattttccactagccagaacttagtaacagaactgctcttagcttttattttgtgtgtttgtgtaatagattcatctacagggtttccattactggggaaggagaggggtatggatgttttagaacattcaacagaggttactgatggccatacattaaaatttatgtaagctacagaatttttatttcatctttttttttcttcccaggagaagaaatatttttttaaaaacagctgatttagcagagatgaaaatgcaaatcactcaaattgtagtttctgggaggccttaggattacactgagtcttagggcacattagcaacatttggacgtgattctggtatttgtcacgctgaggaaattggagtatggcccatcttgttgccaatgcaatgcattttcattagatgttgccttaaaagaatatccgaaaaggttcatgcaatagatggtacaaggttatagagtatcaaccattgaaactaaattgcagaatatgttttgaaaacatatttaggctttatgcaaatgtaggtgacattaatattacaagtgtttcagataatgacaatgtagtcttacctatagaatgtgacttccaaggcctgcatcctctgtctgcttccttgatcaatggctaattaaaatttatgtagtaaatggatgcctattcctcatccacagatgattgattgattatctagggtgtgtctagacattgaccttggctagacattttccccagagtatttcagctcctaccaaggttagcgtccaacttagactcatataagaggccatgtcactgtctctgggggagcactgtgaaattgatattaatgtgtggatggcttcctaacacctgaaggtggctccttacacacaccattataaccttgtgttttctttgaagaccacagtataaagacttggactcatatatatgtatgtacaaaatccctttctactaattactgagaatgcaatcattacttaatctttatataattctatataattttctttccttacttgaaacccaggataagattatatttaggtttgacatgatgactgaatgaatggtaatgtaacaactttgagtgatgtaatccaaaacataaaatatttgtttttataattatatttttacagcacattttaatgattgatggggcagttatgattggtatactttaaagaattaaatagttgtggatagttaatgactttactctgagtgctttgattaattatatatgttgagtcctttcctgtgtggaaagtccagctactgtgcctacccaataagacatgagatatgtatataaaatccaaggtggttcagtgtggaaggaaaggacaaggacatccataaggcaatgtgttttttaacaataattgaataatgtccatcaaatctacttatccacatcatattttaaagcagaaaaggacagttctgtagtcattctgctcaggtccccaactctgaaaggaaagagaaaatgatacctcatatttctgggcttggacttccattgtagcataaacttctctattctcactggaagaagactgactgtgtcagaatcccagcccaagtcctaaggaacagaggagccacagaatggaagattcttttcctgaatgaggattctgaggtgagctacttggggatcgtgagatattcctgagccctgtcctctaagttgccaagtggttgtgtttctctgatagcaactcatgggcttgatcctgatgggtactgcttgctaagtcctaggtcaacagaatatttaacagacagtgggtctacaagtcaggggtgtcaaagcaggcagaggaactcatgtggatttgttggaattgcaaaatctcaggccctatccaagactttctggttcagaacttgaggtggagttctgtggtcatgtttgaagatgctctccaggttattccaaaacagatgcagtttgagaatcacatcttactatatgagatagagtggccagggagatttaagagaatgggcattgaaaataatgtacctaagttggactcctggctctgccttttatattatgggtaaaattgaataagttggctttttggtttttcattttatctgtaagatagagacaattataaaatatactataggattaaattaactaataggcatgtttttttttataagactggctggcatagaatacattatatatgaacactatgtaaacaatgaagttattttaacagccaggtatacaagtaggccttaaactggtttgttgtgacaatgtttatagtgtttattaagtaccctgtgcttgtatactgagcattaattatatgaggtacacagtaagcttcaggaataaattgagaaagacaatgcacatcaccttcaaagagatctaaacatggaattttgactgccagctccaccttagacaccactgtcttgaactgatctaatatccataattctaggcaattttcagtcaatttcaaaatgtggttctcaattattcccatatacatcagaagacacgccaggggaccagagttacaaagcacaaaggcatttaactgcttgtctatctgattttaatgttctttaaaagctattttttttttatcaaaaacctgggcttttacatcaagtgatgatttgacattaatgcatattcctctccagaagtaatcaaagaactgaggttttctatcaaagcacctgattgcactttaaactttattttttatggcattgcatgagctgagaattcatcttatgatttaggtgcagttatgtgcttttcggtgcctccctgctctatgtatcgctagttgtaagcttgggcttaaagcatgggaaagtaatcacaagagtgatccaccggctggcatggagcacagttcatcattgcagctgggagaactgctactgcaacaggtcgtgctagtttattttagactaaaacattggcaaatgtacagaaaagaccataggatttcatttcctgaacaaaatttagtcaaatattagaaactttgttctcatattgcttttagatgcaggaggtaccacactcctgtgggattcatgctttttttcttattaggcactcaacatctgttccttggcagctgaaagaaaatgtggctaaaagattaaaaaaagaagaaaggacgtgcagatcaactacggcttatatctcagcaattagagtgtgggcctcagtgacttggcatctgtaggacttatcatctgaaaggcaataagaataaagaagggtttgggttgcacacaacaacattcagaaggaccacaaacattggagggaatccaagtctcctggacatctggacacacacttggaaatagactaaaccaagtagagagcaataccctgaaccaatgttgctgactagtcaggaaatgcacatcatgacccatagaagacttctcccatcttataagtgaatgtctcagtttcatgctttgaggttatattcactcccagttactcctagtggctataccattagagaaaatgacacccttttatcagcaaccattaacagttgtgggctcgtcaggaaggtatggggccttgtgggcattttctccatccatgatgaaaagtgggaaggatcaaccacaccgcttttctaaatataaatatgtctgtgaaaaacctgagtgcttactataaccccaagcatttactccagctcttcttcacaagattaaaaatgatgcatggaaatcagacatttttaatcccttctctttcatcctctctaagcttacttgaaccatggtgaatatcgtaatgggagacaacatatgaaaacaacacatttgtctttgtagagaaggaatttctttcagatgcatatatcaaagccttctagaaatgagccattgttttacaggatgggagattagttcttggactttttgtgactctaagcagacagatctacttaaccaaggcggatctatctttctggcaaatgtagacaactgaaaccttactttaatttatttcaaatgaaagagaaaaattgcaggtgaggttgactaatgtttgatgggaagcccagttacctccatgtggtttgtagctttgaggaataaccttgcaagctcttaggttagtgcagcctttgattttcactaactcaggatttaaggcacaacatagttccaggggtaacagctcaatgttaccaaccaaaccttgattcccttgtagttttctaagtgcagagggcagggggtaagggtttagctctgtgtgcattgtctgaaaggctgatgctccttacaacagtatccaccctaaccagtaccaccttcaccatcttctgcttgctactgatcagtgctactgcccatcaagaaagcagggctcacccatgggtcaggtgctcagcttggtcttctccaaatgatttacaaagcctgatagacctttatatttttctccttttctctccctcatttttttcttttcttggaattttgaaacaaggtctttctgtgtaggccatgctgtcccaaactcacttgtgtctcagtcactagagttctaatcgatagcagtatgtcaactttgaagctctgcctgttggaattgcagttttctttatgatggttaatgttgacttgactaaattcagaactaagcagaagagtctctgggtgtatctataaagctcttcctaggaaagtaaactgaggaaagaagatccagtctctgtattgatagcaccacactgtggcctgaaattctttgtatttcttttattcttcttttatactttatatcccaaatgcaatttcccctctttccactcttcatagtcccctccttccacttctgtttccctaaggttcactcctcctctatttcccttcaaaaaaacgatcagacctcccaggaatatcaatggaacacagaatgaaaagctacaataagactgggcataaactctcatatcaatgctgggtgaggtgactcctgggattcttgactaaagaaaaagagaagaaggagcactggtattcaccaatctattttcttcctgactgtggagcactgtgaccagatgcctttgattcctatggctatgaccatgccttccccacaactatgcactgtgctatcaaactgagagccaaagaattccttccttttctaagttgcttttgtcagatgatttcttataacaatgtgagacaattacacacttttagtgacttattccaaaagccacctttccttggtaagttacctgtctcctctgatgatttgttgcttgtatctccgtgtctttttcatcatttggatgtactttactcttccatttttcttcattagatggtgcttgagggggaaattaggacttagccttatttcctgtggtctatgatgcagtgctagcatccagtgtgacattaaatccatcctcacataaccatgatcacagtctttgttatgccttgggtaggtacaatgacagactgtaaatctaaccctaaaattatctcctagctgtatattacaactggcaaaatggtaacttttcttgaaggatcaatgaagagtatttgaatgaaagataataaattccatatgtgtttgcacaatagaaacattgttgtgagtgataggtacagtttgggatgctaatagtgttcttgcaaacttgcaggagaaagtacaagctgaaccacatagggtagatagggattccaatatccaatttaataatatctcaggaatgagatatttggctggatgaccagggcttggggataagcttagcaaaggcctatcatgtcactatgaagcccttgcaaaatagcttgccaggaaaagtttgctggtgtttgtgtgtatgtggtggggctggatgagagaaggtgagggaggtttggtaaggcttgtcatgtcactgtcctctagtaccacagtctgttcaatacatgcagggcagtgttttttgtgtgaagaataaccattgtttgcatttatacaaagggaaggcttaccaaggagctattgttttgcacaacaaaactttcctttaaggacagtgcacttctagtgagcaccaaatctttgtcaatattgttcttattcagaaagatacctaggaagcaatgcacagcacatcagcatccagctacattaggaaaccagcaagtgtctggtttgttagggagagtcctgtacataagctattatactgtttcacttgaattttgaggcttctttagagttctaaccttcaatgattcctaacatgaatatttaagcttcctggaggtatacagggcagtatataaatttagaaaggaacttacaactctttcttaaggagcaatgacttctaaacttcatgtaatagatgggattcacaaggcccactcagccatctgttttgcttgatttcaggccatttccatttttttcaggacacagaggcacatagtgtgcacatatgtgtgcagaggtgtatgtctgagtgagtgatgacagcacgcaacactcacacacaaacaatttaggtcattttctttctatcaacgcttgatcttgtacagctggatatttagcagacacatttactttaaagttactgtttttgaaaggaaaatgttttcaaatctttttttttaacagaagaaaaaaaagctttggatgactagagtaaggttccaaagctagcacctctatgtgcctgttctcggtaggagggctggttttcagttccatgtggcaggtaatcatattaattacttcccttgttgtgaccatatagctgacaagagctatttaaacaagagttaactttgtctcatgatttaaggagggatgttgtctaccctcaggaagagaaggtactgtggtaggcatgagtcagctgctcaagctgtaacttcaggtagaaagcacagagaggggaatgccagtggtcaactcaatttcttttctcttctcttctcttcttttcttttctttttttcccagtctagtacctcaacccatgactgactgatgccacccacattgcaaactccatcacggatgcaccaggggtggttttgctgggtgatttcaaagccagcaaacttcaaagttaagttgacaatggtgagtagctgccatggttgttgaaatggctgctgtttagaataagttttataccctagtacccaatggttgtggttggaattgtgtcttcccccagcacctaaaatacaatgtaacttggaaataaactcttgcataattatatttagatttgattcaaagactagagatatcattaagagagaaggcacagtcaaggacacataggaagatgacagtcatggaaagacttgagaaatgctttggaaagtcagaggtggagacaggaagatgcacctgtcagccaaagaatgctaagccaacactagcacaattttccccaggtatttgagagtgattgtagccttgcagacatcttgattttggatgttgtgcctccagaattttgagaatataaacttgttttaagcaatttgcatttgtgggactttgttgatatttccctaggaacttaacacagaaattaatggggctcaaagtatgaaagtagatgaaccctaaacatcaaaatcgataattatttcatcagcaattgtgaagagcacaggtaacattttctgtcagggaacatgagcaatgctgattggttctgctgtggtctggtgtctaaaaggggtctcaccaaattaattctggatggtatttattgaacacttgctaagtgttctggatcttgtgataggtatattttaatatatttgtattttagtgtttattcctcactgttgtgaagtatctactatctatatgtctttaatagatgaggattttaaaacacagaaaagtggaataaaatgtgcaagtttacagaattgggagagttgtgtctttgtctcaatttgcttccaaagccgatgttcccactacttttcattttgtgtttacactgtctagaagtctaaaacagtcatgcttttctatgatcaaaaaatagaaagaagttattgagtgatgttgaagtcactcataatgagcgtattgtgtgcatacatcctatatcttattaattaacccccacaacagctcttcaaagtaccttcatgtaacttatgagcaaagaaaccggagtcacaggaaggagtttgatctctttaagtaggtttgtaatggttgtcaaggtttgaatctgacactaactcttaccatttgtctagcacctgttacatgctagttgcacattctctttgatctgaacagtgctcctatagggaaggtgtcttcaggagtcataagaatgatgtggcagaatggaaaataaaatcttgaggggctgctgtaccaatgcaagacaggctggtgaagggctactgcatacaggaaagagaagcagcagcccacttggtgaacaggatacagacacagacattatacagaaatggctttgacctagcaagagggtgtgaactgagacaaggacttggtataggatcatgttgtttgctgacaactgtgggaaactggctaaggcaggaggaaggcatccctgggaaggctgagaaattacttgtctataaatatgtttccatgaatacatctggatgtttgatcttaaaaccactgattttcatataatttttcttcatgtagatggtgcattctttggacaggtttcacaatggttgcagattttcccagtattcagatttggattgatttaaatgaccctggggtcttcacatatgtgcctattgaagaggtattgatgaatacatatctctttattttccaagagatccgaagcttggagatagatgctcaaaatcttgtgttgggtgagtggaaaatacacaccagagttgagagttgaggtcaactcactcaagtgaattggtgtttaaaacatacattgtatagcaacaattgttttacatgtagagtttacttgagcaatgttgacttcagcaatttcttctgttattgaaactttatggggtgctgtgctaggatgcttttgttggggagtattaaacattgacaactatagttgagaactacttttgataatcttagcacatcacttgaggttaaaaaaatcaggttttcttttccacttccatgccactggtctgtaggggataccctaaccacgcccgcttggggctggttacaggtaattctagccatgcctgcttggttatggtcaggggatgtgagaaaggtttaagagtgagggcccccttctacttaccttgctccctgctgactggctaggctgatctgagtgagtagcatcttcctgaataaactaccctatatctagacttgactccatattgccgttccactttactggcccttaaactgttgaagtttttctaaatgttattcaggtccctactctttctttttctgtacagaaaaattttggtgaaaaaattattaaaacatgtatcagtttgcaaaacctgtggcagttcaccagtgtcatcggcaattgtgtatggcccatgtctgtggctggaactgcttccaacattccagtgttcctaggtcacctttagcatataaccctaaatctggacattgagtagataaagtgtgtatgaagatataactttaaaaattataaacagtttgcacaatacaacaatttcaccaccacttcttgccctactgcacctcctccaccaaaggacatgcatgaaaattaaaagcccacatcccaacatgaaattcatgctctggcatgaggagcagcatctcagctgaagccattgtacctttctaagctgcatcctaataccaggtaaaacctcttattctgactctcaaagagtctaataagcactgatttgagaatgaggtgagctgacatctgagatgcctctaactacgtccttctgtggatctaatatctaaggcatagacatttttcaggatcctggtgccttttctcctactgtcacttcagattgaagtgtcctaagcccatcccataccaattaccaccattatgactccatccttcatgtatcacttcaaatacagttcttacacacacacacacacacacacacacacacacacacacacacacacacacacacactctagcttacctatttcctctcagttttctttgtcattttttcttgatgctttctgggcaccaattttattctatttgaaaggactcaatgacacagtgtactgtactcatttaagctcaccagaatccaactgcagatcttccaaatgtagagaaaggggaagagagatgttgttcccacagctggaatgggtcccctggagtttcttgtggcattggtccttgtgaggcttttaaagtacagtctgatgctactcaattttcacattacttgcagactttagaatccattctcccagcaagacactagtcttggttaattagctgtttgcatgtggctgtgtgacctgcatttgactacttgcacacaaattgccttttgaacatcctattccctcacttcttcctggttatttgagaaaggaaataactgctaaacctaatttgtgtttaaggctcttggatccaaagccagtttgctgggtttggatcttattgggtccctccttgtatagcatgacacaaactagagcaactccttctgaaacccactctccttatcctcaggtcacttgtttgttttcttttcgtttttcccccatttttaatttaaattagaaacaagactgttttacttgtcaatcccagttccctctccctcccccctcctctggccccagttacccccatctcaacccctttatgctcccaagggagggtgagaccttccatggaggctcttcagagtctgtcatatcatttgggttagggcctaggcccgctcccatgtggaatgggctcccaaagtccattcctatgctagggataagtactgatctactacaagaggccccatggatttctgaggcctcctcactgaacccacgttcatggggtctggatcagtcctatgctggtttcccagctatcactctggggatgatgatctcctccttactgaggtcagctatttttttggttttcaccagcctggtcttggcccctttgctcattgcttctccctttctgcaactggatttcagttcatatcagtgtttagctgagcaaggtaacccagtcacaaaaagacaaacatggtttgtactcactcatatatagattttagacatagagcaaaggattaccagcctaaaattcacactgccagagaagctaggaaacaaaggaggaccctaagagagacatacatggtcccctggagaaggggaaagggacaggatctcctgagcaaatgagagcatggggggagggaagagggagctaggagaatgagcagggtagaagaggtggggtgaggaggacatgagggagcaggaaggttgagttgggggaagaatagaggagagcaagttaagagataccataatagagggatccattataggtttaaagagaaatcaagcactaggaaatgtccagagatctacaaagatgacaccaattaacaatctaagcaatagtatagaggctacctgaaatgccctcccctgataatgagattgatgactagcttatatgccatcctagagccttcatccagcagcccatggaagtagaagcagttgtttcttttcattgtcgaaagtccccttttagatgatcatgcctataactaatgatgtttgggtgacttacttagtttctataatactgattgtcaacttgataggttctagagccacctaggaaatgagaccctgggcatgtctctgaggaatgttctagattaggttagctggggtgagaagactcacactgaatgtggctggcacaatttcatggggcagggttccagattacataaaaaagggtgaaactagtattcctctctctctgagtctgtttcctgcatttaaataactgccttgtgtgcctactgccatgtcttcttctttagtatggactgtacactggaactgtgagtctcaatagacccttcctttctgactagtagggggtcctgctgccaggtattgtctcccagcaatatgagaagtatctaacaatggttcctaaatctctctgcttttctaaacttgtaataacgtggaaaatatttacttgaaatctatttctgaagcacaaagagtagagaagtagtacaaaagcacatagtatgattccagcaagattgcccatatttatttcctttgtttgtatacagtgtcaagtgttcaagtcatagtctagaaattgtttacccacaggtagtgctgttgcttagtcaacaacaagcatacttttgctatggaaattactttctaatcttagaatattgtgctaacctcattttttagagtagtacatcactgccagatgtcaaaaattgtcattatacacacacacacacacacacacacacacacacacacacacgcacacacnnnnnnnnnnnnnnnnnnnnnnnnnncgcgcacacacacacacacacacacacacacacacacacacacacaagaaacaaagaatagaagatgtcaacatttaaaattccttatactacatgaaatgctaattagtagaattggttgaaaagctcagcttttgaataaccaatagatgatacaagttagtgaaagagattgatgaattaggcaacagctacaataacatgaggtttcatctaaaacgtatagattttaattttctcattagtcctgattagtggtagagaatctttttattttcacattcccaaaaggcccattttattacagagagcacactgagctctttccttgcaaggataggtcctgttccccttctccagggtgataagtgtgtctcttccagaatccctagttctctgtagtttgtagaaatagctgatccgtttgttaaggttgtgcaggtcatcggcaaacattctgcttccaacccttctcttcttttggatacaatgctgtaattcattttctctccagcctcgaagccatactgggcccttgatcagttcttttgggtgcttttcgaaactccccaggattccgatgttgtcatatacatcaaacagagcttccttctcgttccagcgatcgaccactcggggggtggaagagtaagcctttcacgggccaatagtggaacaccctaagagaaagtttctgcaagccaagggcatcaagctccataggctcccacttgccacccaaggaagactccctgccattactctagtgcctgtccacctcaacagggcatttccccagaaaaatggggaccaagtgtgaatttcaaagaacagacaaaggatgcagtgtcagccgggtctcacatgggtaatggaagccatcttagctgcaggaaacagctagtaacccagatcaaggcaaacactccttgctttaccagcccttttttgcatcccttccagtggcggtcaaaaccattgaaaatgcagtcccattccggagcttctgagaaacatggcattattcttcccaccttgagagaggactcttatcaatcaacaagcttattttgcaggtcttggaggggtggaatgaaacattaaattttcctctctcttattcttggtaatactttatctcaagtgccattagccaactcactcaataactccgtctgaataatgatgaaggtatactcccagaagtccaaggcatctgtgtcaaccagataccgcagtctgtgtccctgatctttgcctaacatatttgagtcactgtcaagactgctgcttataacccacagaaggcacataggctccttatttgagcacttgattccttttggggtgctgtttggaagattgatggagaaagtgagttgctgggcgctgcacccacttcttgttagctctctgttttatgaatggttactcaatatggccagcagacccctgattctggacgcagtattttatccaccacaatggacagcacccttttgaatttcagctccaaataaacccttcctccttttaagttgcttcttgtcaggtgtttagtcacagtgaccaggaaaagagtagtacgccatccctaggatggatcagaggaaattcccttatcttccgggttttgccacatcacctgcaacacctcaagtcagccagatataacttgttgcttctttcggtagtgatgcatatgatattcacccagggattcagatcttaatttttttcagttcctttttcatgtcatgctaaaaatttctggggaatgtatagtgtcggtctcttttcagattcatcatttcaatattttcatctgctaccactgtttaattaggagcggttcctttggtaggctccttttgtataactttaatgaaactgaagagcatgaaatgcggtttccctgcttttaaatgaagctacttttatagaaataagatgagaaatggagaaattgttgaagtcacagtgcatgaaattaagggagcccaaactgtattggcaatagtgttttttttttctcctgaagttgatgttttctaggaccaaggttgtattgatgctattttatttatttatttatttatttatttatttatttatttatttattcatttattcattcatttatttatttaagttcatagaattctgacacacatgcccttaaggattcaatttcttgttgtttaggaaaattgtgggaagcaaactacatgtgatagagcactattttcaaacacaagggcaaattaatgatggcaccttgctatgaggtaaagtctggaattgtgtgtggttatgtgagattcaatgtgtggaactgaaatgaaacaattatgggagaattgaagcatcttattctgtaatcataagccaggtaccgagggaccctctaagccaacaaggattctgagcattctgtccactatcagactttctctcatagtattctgtttctacaaatatagaaaagagggtgggtatagcatttcttttttcttacatttaatccacatattaacaactttggaaatttaagtggcaaattcattaatttaaataacccaaattattatgtcactttacaattttggctaacttgataattggcagaaatttgtggagatgggcttttgggattggttttaattggtagctgtaaaaaattatgaaaatcatatgtgatattttctgctgccttggaagaggtgatgagtattctcagcctgaaagaaagcagcagtaagttccccacattaaaaaagtatatagctttaaatttatttcttcttttattatgtgtgtgggagggcatgctcttctcttccgccatgtgggttctagggaatgagctcaggtcatcagttaagtgcttttacctgctgtgccatcttgatgcacaagcactgcatagctaaatatagaatttttaagatcagcagtgttgctttcagagaactgggtcagatcagggggcattaggacacgaactccagtcacaccagcctcttcatgccctagcctagactccaggaaagaagaatgggggacaaaagaaagaaaaatcccttctgcttgtgtttctgtcatctggctgcctgctccttctggatagttgagcatagccagcctctacctcatatatgtggctcagggtgaaccaggagctgaagctgaggagatgtgaagccaaacttgccttcttttagagcactgagatgtggaaagattcatggggaaaccttgcaagctctcagaaacacttcctaaaagtctacatggacacaaccttcatggggtaatccatgattagtaacaatggaccaccaccccaatggttacttgagaactttgtctctctttcctatcattcttgggctctattccatcccccaaataggcatgccttgagggacatgtgtatgcattagtatcccaatcccctgcattcacagatgctgagtaattgtggaagaggtgactaggtctcagtctgttagtcaagatgctgcagccacagggccctggctttaaagcatgtgctgctgatgcagatatgggacttaatggcaatataagagcaatcttaagctggaaatgatttgaataagttagtgtgcactaaaaggcaagagatttgctaaatttttgaaagaaatgtaattgaaagttatgattgggaaaaaaaaaaaaagaaatccatgtccaaaaaaatcagttaaatcagtctctatttcattcctccaatcgtgtttaatctcgtttttgaaattttcttctgaatttagggtaagcccattgaagaaacccctcttgaaatcaagtgcataaaacaaatgctgactcttctcccccacaactggaaagctactggctttttttttttatattaataatacattataaatatccccagagctctgtggcggagcacgtgtggggttgtggtttaatcccagcactgcaaggaaacaaaaaaaaaaaatgaagaagcagtttctggaaaaaggggaataatagcaacagcaagtggggtcagtgtcacaaaactcaccattgttttttcattatttctgtaagggatttttagaagtataaactaaaagttgtttttagttatccttctagcatgcttgagttttactgtagtctgtcttgaattttctgtgttttacaattctatatgttcttatagtatacattgagaatattctcctcacatctcttctcatttccactccttctctttgtctccaagatagtttcaattctcctatgtcataatacatacaaatgattttgtgaatctatataaaatctcagaattaatcatgagagaaaacacgtactgtttgcctaagacgggcttaatttacttaatataattatcttcagttgtgtccagtttcctgtgaataacatgacattcttttatataaatgcaaaagaattccattgtgtgtgtttgtatactataagaacatatagaattgtaaacaaccctcatcctcagtgcttcttggcatctatgtttaaatgctcctgtcttggctgccttcaaactactccactgaacagtcatgaagacattcatatagtgggctcttatgaggggtaagtccatgttgaataggggatcttagtaatgtaaatggggctttctagactctctttcatataaagaaagagagtctacattggatatcccataataaatagttgcacatttcaactcagtgaaagtaaatcacccagcaagagaaagtcatttacattccatgatacccgcaacagcctcctctgatttggcagtctcagctctgaaccaacaacaacatctgctggcaatttattctctattatctcctacctacgacttaacctactggatcaaacaattcgatattcacagctccctatccacctgtaagtcaaagtgcttgcttgtcacaatttaaatgtagctttagaaatttttttattgaaatgtctttatataagtttcaaatagataataatatcatttattctaaaccacccctgccttcagtcaatttataatttatttcactatgactttggcttgattgttgaaggcttaaggaaggcagacagaataaaaggagtgttgcaatgagaaaaggaggaatgctgagtgatggcatatgctgatggtattttcattttccaggagcttccttttttctcttctctgtgtgtaaggattgtgccatttttcagtctgggactatctctttacttgtccacagaggaactagaggtttttgtctttaggctaggaataagctgagtgcttagaatatggaagatgtactgtgaacacactatttatgggattgtacaatggtggcaattgaagggtcaggttagggctgggacaccaggaagatgagaaccacataggcgttcacactcttgtagggagaattttccccacccttcagtgaggtggagtcagcagctctctttctgatttttcacctgttgacttctttagtttgtcacctgaaaatgagttcctttattttggggactgcctccctgcgattgtcctacattagataagtaaatctcaaatccctaagaacaggtggagaaagagaatgtatgttaattatggcaaggctaagctgttacagcaaaggggagcagaaataaaatggtttaagacaacttgttcttaagctgtgcatgccagggaatcagggaggtgttttcctcaacagtgatgatgatcaatggaacccaaactgggacctcagattctaacaggattgtgttttattgcatgggaggggaacaatcagttcaaaagacttctttagagcaaagtgacaatgacattttaaaatgcaaaaattactaacttctccatgctggggtttttctggtttgaactcatagactagtgtgtgctgcactgtatccgccccattgtgtgtggaaggttctgtgtcctacccctaaccaaaaagatatttgcaattgatacctgatgggaaagggaaattaattttcttcaatggagtgacattaggcatatcaagcacatttgagggctggcctcatgcccaggagtagttggctgctacaaaactgactccatgatttttctgtgagcttttaattttggtttattttggtatttatctcttcttgtttttgtttttgttttatgctttgtagttttgttgtgtgtgagagagatacacagagagagataacataaagttgtgggtagggatgtgggaaagatttgggaaaggttgggtacagggaaagaatctgagcaatatttatatataaaatttctaaaataaaaccaattgcttctaacttgctattcactggaatctagaaaatgtaatttcatgcataaccatgaaatctgagagggcagatgttggggacaactatctatctatgtgacactctgtctgcctaactatccacatacctattacttcctcctttgtgcacttcaaggaagacaactcagagcccccatgccttactccatgagttccatgcatgaggagacaggacagtggttctctatggcatgtcggcaccaacttagtcagagtctggtgactagaaaatggtagataagttatcagtatgcttatagacaacagcaagaaagaagcaaacagtccaaacaataaccacatcaacagctaccacccttgctataatatgcaacttcccattcacagaagagagaaagtggacacatggcagctagaagctgttaccaagactactgcatcaggaaatagtgtatatttattccagtaggatcttttggaaaaacgtcaattgttggattttctctgtcaggatcaggttgtggaatgtaaaggttttgcagtctacttctgagtctacatttgcctgaagcaggcctgggaactacttgaaatctgctagacttttgatttcataggtaatgcaacttgctaagaaatgactctcagtctacctctctgtgtataaagagattagataccaaataagtaaactgctactaaaatattataagggaaatatgcattgaatattcataatccactgaactgatgaggtaccttgagggttttgccttaccatgctgtgggtggcagagagctatgtccccaatgcctctgctcaacatcaagaaagagaattatgctacacttccctagctggaagatctacattcaaagtccgctgcactgaagttccgtttctacagaatgtggcttatttctgaaacttgtataactgaaaaattgtatgtcaaactatcataagttggtgacttttgtgtttaaattgtttctattgacattgcataatttttagactgattcttatgcctcctgatctcttgaataaaatataattcgagttaactgatttctgtgtggatacatgttgtatcctggaaatatttatgagaggtatttgggtgaggcttcaggtaacagattcatgttctgctattttggggtatagaatcaattgttttctgattgtatgaggctttagatttctggggtcttgggtgatttaggtttctgactacaggccagcagtgtcccatccagttgacttgtagctccaagtctgcttccagactggcagttcctgtctggatctgcttcagagtagtaaggagcaatgatccccaaatgtatctttcccactgtatcctgcagagccacagttccttagtgagagctctgttggataaccaaccatggcataatgaggggtactgagatttagcagacatttattgtgtgctcaaagatgttccgtaggccgtaatgctaagatttctttatttagataaattccagccaaacgcaagccagagcgtgcccagaggccgcaagccagcgaggccagagaaggggccttcacgtgtttgcggccccttaagaattgcccccacttcatcttcgacctcccctgaccacgcccgcacgggcatggccaggcacacctataggggctattaggaggcggggctacagtgtctccctacagacattctctattttctgggaggcacttggtttctgaaaccagtttgaaacatgttttaagtttaattgtattacctcacttctagtcattaatttctgtattattactataatttgatatttttgttgaattggattattccgtaatccaatgccaaggtttatttcttagccaagtcaaggttaaggtcatactgctatagcaaatatattttaaaataaaacaatctttgtgagagatgtgaggtatatttgtttgaaaaaaatcaaagccccaagtagggttatgctcagtaaggacattgatggatttagattttccagtctgttcttctaaccttcataaatgcctttttctaacggaagagagtgactgtttcagggaaacaatagtagtctatcacagctctctagcaagcaggtctgaattcttcaagtatgttcatttgacatcttataagtccctatgctatgccattaatttcactgttgcccagttttacaagcactaagaatcttataaaagggctgcagcaatggcttagcatttaagagagctttctggtcatgcagaggacctgtgtttggttcccagcattcacatggcaggtcacaactacttgtaactctacttccagggtacccaatacccttttctggccttcccaggcattaggcaaacatgtggtaagattttatacatacaaataaaatgaaaattagtaaatatattttaaaaagaatgaatctgaaaccattctccacaaatgccttcatacaggagtcatgaaatcacctgatgtttttcaacgacaggtggtttagtctccttgtggggaactggccatgtctgggaatgtttctcagtagcaagtggtttagcttcctgccagagtattggctacatgcaaaaatgtttctcaatggatagtggactagttttctttgggataattggccacgtggtaaaatatgctgaatatttgaactgtctggtactgctgtctgaaaatttgtgtctccaacagacataagttgaaaccttaccaccaatgttttatttaggagtgcagaataaaggaactaaagtcaggaaagggaccagagtctgaactcaatgggtgatcctgtgtttattgagcacatagcaggggccagcctctatctttcaagaaatgggaggtctgtgaaggagaaggagcttggtcagggctttcataagggtgggtaggggtcttaggtatggacacgggagcagatagtaacagccttctcctgggactgtttgttctgatagggaaatgtaatttttagaaactttttgccccatctggtggcatgttattgactgacaggagttgagcagtgacagcaagacagtttcgtagttggacttctggttttctgtggctggggctgtggttggttataagggctgttcatcaattaacggggtgtacttagagaagcaccaaaatgctgccttgtccctctaccataagaggattgagcatgtgtccactctgactcagtaagcattatgttgccagatctcaaatctaccagcactttgactttggacctccctggctttagaactgagcaataaagttctgctatatataaactacccagtatgtaacttctgttaaaacatcatgaataaactactgtatctggggacttctactagcatcagtactcaagaggtggagtccatggcttcacaagtaaatgctgtctcacacaaatatctgaaaaattagatttcctaatcaaagacccttattttcagattatgggtgcctgatatgaaattaggctacaggttttctggccacacattaagctcaatctctaataggtagtcttaaaggaaattatacctttaacaaagctgtgttcttcatctccacctgttctataacagtgtctactcacttgtataattttcctatcatatttgaagagtgaaaaattggtaaaaatagttgtaggggaagagaaaaaagccacatgagatctctctcttcttctctctctgcatatgtaaaaggcatataaacagataaatatagatcatgattataaagcagtaaagactattttggaatgaggttgcagaatcagtctcagttctttgtatctgtgtttgtgtaaatgtgggtggtatgctttaccatacgaaataaaaatatcaggcgtgaagttggaggcactgggtagaagagactgcacttagggaggcagtggtcagaggcctttatgttgagtgccaaaaaggagacttggttgctcgggtctgtgactgagacactgaaggataagagagcaagagacctcaatgaacaaggccacaaggaatcagggcagactgaagggaattgcaggtgcttcccaggtcaggtggttagggatacagggcagagaggtctgtgtactcaataaccccacatggcccaatgttagtggcatttttttctttttgcaaatcaaaagctaatgacagcaaaacaaagaagaaaaatgcagtcgtaattagtaagaaaatataaagataaacatattatgcatatgttcccaaatatgcatatgaaaggactgccgctggtggagaatgtgcagagggagtgggcacagagtggcacagtaggtgcctgatctgtatttttcctttttttttttttcaaagcaattgcatgaaggacaagaatgttggaacttagtgtaataggatagcttgtcttagtctacaactgtcaggccctggggttcctctgaatttttctgagtgttccgattataaacagttgagagaaacaagtaacttatgtatatccttaaaagtccacttcaactttttactgcatagttgctgctcactgcctttattgtcaagtaaattagcctggaaggacatctgtactggtgttacctactccttttctcagaacagtagcacagttagacccttcccaacttctatctttcctttatctattggccccctctcatcccagacacacacagttaaaaatcttctttctttttattgccataccttcagtttagcaacttagtgtgtgtgcttgaaagtcgagctgcctagctattcaccagctactcatcaaactttggtttgtattgtgtagcctagagttcaagaccttgaggaagtaggatatagaacatgctattgaaagattactttgtttcttttatttcctatttttcatatatcttgtcccagtggatatcagaaatcctgtgagctcatagcagacacagtggcagtggtgtcactgaagctgccatcatacacattcttgtgtcctttgtgacaaatttgcttgcctcattcagaagtttgtctccctttggctggattgcaacagtttgctatgacaatgatgtgtacagctgcagagagagaagcaggagggaggctcctgggaagttaaagtttctcaggccttagtgaggatctccttttgcagactgtgaaatggaaccttgtggagtttgtgctggaggagccagtggggacagatgtcattgtgggagccctgtctctgtctcctggctgttttcatctaatatatctccatataatttgtaacaggcagcacagtctagccaagtatttgatctataaatagacacatctaagggttcgattctttacgttcacaataatgctgtcactgctagcagcatttttttttgccacaatacaattttaactaagaatgaacaattgattcccccttcttttttttttatcttttcccttcctttcttttcttcatttctttcaagttctgtgacttttcttcaaggaagatctgaatagaatcttaacatgtggggtgagtcatctaaatcctcccccccctgctgccttgaataatttttgtgttcagaataaaaggtatccttgttctgatttcttgagaagatgattgaatactcagccacatggaaaggcccctctcttccactttctccatgtcagcattattttagagttaatcttacaaaatggcgtttgactcttggataatatctccactaactgcacactactgtcactggagtcacagaagtaattcctcatagatggccttcttgacatgatagtgtctcagctgaagtgcttggaggtagcatctccagatggaagctagaacttttgactggcctgtggtgtcaagaataacatttacattgacattttctggaaaattagcacctggaagttatttgtttggaactggtggaaaacacagatgtctgtttaaatgggtgtctactgaagtctggggcatttgaattttgatcactagttgggggatactatttgggtagggttaggagatataaacttgctggaggaagtatgtcaccaggggcaggctttgatgtttcaaaagtcaaatatcattaccagtttgttttcttcccttcctgcttatgtatcaagaggtaagccctcagtgtccatgatgagttgtcatatttgctggctatcttgcttccttgttattatgatgaaactataaacttaaataagatttcattgtataagttgtcttggttatgatgttttgttacctcaatggaaaggcaactaatgcagcgtttatttaggcttacagttctagggatataggattctcacagtaggtaggggacacatggcatgatggtaggatcagaaaactgactgcatttttattcgtacataggaagcagaaaggaataggtagcaaagtgagtctatagaaccccaacgcctcccttactccccacagtgatgcacttcctccagcaaggatctacttcctcaatgttccataacctccccaaacagcactatcaaccagagacaaaatgttcaaatacatgagtctatgggggtatttttcaatgtaaaccagcatactggcaaactcttgatttgtaattctatgtgtgtgcttttctgtttcatgatacagatatttagtgagttcctattgtgtgttaggaactaaggttactacttgcttggaataagacagcattccatcatctacttgggaagtggacacatgtagggagccgtccctgcattctccattacaatgatggcgcctgaaggcactgaatgtaaattattgcacaggcgctgggtaattttccatttccttgatctctgcctattccgtggcgtcatatggcctgaggagctgaagccaatcatagggtgacacgtcccaggcggtggctaccagcctttattaggggacgggattcttgtctcggggtctccgctctggtaagcttatgctctcctctctcaagatgcattaaagctttcctgcagaaggatccgaatgtcctgtgtgattcttgccggcgagaatatcgcgcgggacagacacacatatgaattgttataacctggtgcagtaaccactttcaaaattcaaggaatcagagtgggtgcaaagaggacattttgctcagtcagtgtaggcagaggaatccttggtggttgctggaaggcacttgaaaatgagtaatcattgacaagtaagtcaggaggtaaagaaaccacagacagaggatagagtacccttgatgtcctgggagaaaggaaatatgattccactggaaattaaagaatgtgagcatggctgagggggtctaggccaaatataaaactggatgcatggtggaggcccaattcacaggcatttttctgagacttaattggactgtactttgttgtgacattagtggaatgcaattgaagcatgctggcaccagatttatggattgaaaaatgatatggacatagggtagattggggagagatggtcaggactcagttgcagtagttccaacagaaatgttcttgggttactgtactttgtgcttgatagagggtttcagaggtgaagcacttagttactggataaatgtggagaatgatgtaagatagaatagcacccagaaactgaactggaagcatttgctgtgctagaaagagaagaaggggcacattgttgtatacagatgactctggaattgggaagttctgcaaagcccatggtgtgtgtgtgtgtgtgtgtgtgtgtgtgtgtgtgtgtgtgtgtggccatggaggaggcagaacaatacaacgaatggtctgaggctcagcagacctattggaccatagggctagactatattggtcactggcacattatttttagtttcaactgttcacatgggtatagtacagacaccaagaaaaataagaatgagtcaggttttaatgtaaatcttgcctctgccccgtcttggccatgttactctgaacaagttcctcactttttgaagccctgtattcctcatctaagcaataggaatattcatggtaacttacctcacagatcacataaaatgttgtcaattacctggccctttgtaaaaccaatcaatatttagtacatttttaaagcaatattaaattaagtttaaggagggagttggaaaggggattgcatattttagaaagaagaataataatgggcaggagggtaaggaacaaactatgagcaaatgactgcttagaactgtggaatgaaaaaatttcactagtgactgttctaataccatccagtactaaaccatgcatgagaacacttcagcagcaaatcattcagggctatctagtaccaacacattcttgagaacacatcagtcatgagtggcccaggaccattaagttctaacacagtctggaaaacccatcaatagtgggtgtcctaggaccatccaataccaatgcatacatcagaatatttccgtagcaagtggttcaggagaatccagtaccaacacactctgggccactcatcaatagtgagtggcacaggatcatcctttactaagactgtccacacactcaagactgttaagcagagggtctattccacggaatgtggaaacagaagatagactctcatggatttaaaaataaatgaaagatgaagcgatagagaagtagactggaggatattgtttttgtaagtttggatataaagaatctcagcatctaaaggatatctgaaggagacaagggggctttggtaaaaataagaagtaagtattttcatgaacaaaaagaatcataaaactttttgggattctgaaacctgagttacatctcagtgctaatcactcctcgctatgttaggtaaagtgtgcttattcctgagatccaaggtcacaagaaaaaagaggaagagaatttccttaaggttgccaggtgttgtgcaaaacctctccccaattcaatcatttattgagtcttcatggagacctggcaagaaacttgtccattaataatttatacttactatgcaaagaaagtaagacttagagagaacaggtaattcacacaaggtcaaaaatagaagatgggttctgaccaatttatattgcttccaaagcttgtgttatatctcctgaactactcagtgggtttattcacaggctagaatttagaggtgagtgtaccagagcatatcagcagtctacctacattctgcattccttccccatattcctgcaaattgaatctcacagtattctttccatacagttagaacatctatccttgttggaagtctcagactggaggaggctttcctatgcagtgaaagggagcagatatctggaatactgagatttcttctgctcctctgcgattttagcagtgcctgatggatgctatgggcaatgccactctgctagactttgatgcaaacctctaagatatggcatacactatcatcagatttcgttcggcatccagagattgctgtccctgttaatataacttgatagcacatcttcagcgggattttgtgttagtttcttcttagtgataaagcaaatcatctcaagtttactaattgaaaacactgaaaactatgattattctataaccatgaggagcaaaggttaagagggcctagaaggcattagcaggtaaatgctcatttaggagctaaagggtatgaacattttcctggttcactggagtgctaggagaatttataccatgtgagttatatcctatttcccatgcttggcttctctctgggtccttgcctcagcttctggaagtctcacttctgaccttacacatggtgttcactagaatagtgggcatcaagtctggtgtctctaacctcttcctctgcttatgatttttacatgtaagggctcttgtaacaagaatgaacccatctataccttgcattttcatatatttactgtgtgtatatgtatgcatgtatatatgtgtgtaatgaataccacagtatgtgtggaggtcagaagacaacttgcagagttgagtcagttttcttcttctatgtgggtctgggattggtcatatcatcagtttcgatggcaattaccagctgagccatcttgttggccttgaaccatctatataaagcaggcaatctctgtattatctgttcaactgatcagtgattataattccatctgtgtttttaaataatttctgctataattgtagggtctggatattaggatgcagttagctgggggcagggggtgcttactctgccattcatagcctcttgttgaggcctttagtcttctactctatactgagttttcacaataaatcacctccacaagaatctttgtttcagcatctgttttcaggacagtgatgaatactgagttaaagattcctgttggtttgtgtgttaggaagggcgatggaacacacaggccagaacactcagtatacagcagcctccactgagtgcatgcacatccttgctgagctcactgttcttctggcagacaaacaggaagaatagagagacctcactaattagattctccctgctctcctgaaccccccccccccagtaaccttgcctaccagcatgtcacagtgcatagcatttataaacacaaacgtgagatgtgccgaaactgtcaaaggggctgcttgttacttagtaaggatatgagtcaaggctattggtcccatggtgctatgtgttgaggcataggaaacggaacatgctaccttcagggtcattatgcaaaacaggaaggggagaatggaagcttgacagactgtccgtatgattattagctatctcctagagtctggaggtgcagccttcatgcacattctgtaactcacttaacatgcctattgctgtaaacctcgtttggttctgtcccatcttgtgccgttctccttgttctctatgtatgctgatgctccacttacttccaatgtggcagggttcctggtgctggtggtccatatacttaaacctaggactttttctgatgtgtaggccaggtggatcacaggctctgccaggagataaaagtgcggggtcggggagggggctcaagcacagcatgcttaagtccttgaaagtcctacttcagaagccattagttggagggctgtaactgaaggaggctttagtgttaatggctgtgatatatgctgcacacttacttctcctttgcctctactccctttcttcagccctaaagctccaatttatacttatacttctctttacaacataatcctcagcccctgaaatgcacacctacatcccgactccacatggcagcagcattcacaatgcctctcctgaaaagccttttatgatcttgaattttatacttctcaacagtttttaccagtactttcaaaatatacattcctaatatcccaacaaaggggagggtgcattaaaagagaaatactataaaataatttggtgaagaactaataaaagatgcaatcagtcaagtgagtgacagaagtggtttctttcaacatcaaatctaatggtttctttttgtagtacaaaagtgctccattaacagtgtgagtcttttatttaggtaattcacacgagtggttgccagatgtagtttattttcagaagggcacacttatagaagcagcacactgagccagagacagagttatctctatctatcgcactctgtgatgacctttcagagtgaaaatagcactgaaattctgaatctgaaaccctcaaaatcagatccaagtagcacttcatgtttgaaatgatggttgcatgtcagtgctgggctacagagaatggtggagtgttttccttcctccagtctcccaggatataagtctttctttcacccagtccccctcccccaccatgtgtgactgtggctggttgctatctaccagggctgtgctagatttcatgttgattctaattcccatcctgcaatcagaactcatctgttcaaagccctcgttctcatgcttttccaggagccgatcaaattagttcacattcattcatatggtctctgtgtttacagcagaacacagtgcggtgcatttctatcccaaaagttcattgaataaccagtggtgggccagggagtgtggctcaatggtggagcactttccatggaggctggaagctctctgctcaatacttatcactgtggaaaaagttgtatcactttgaaaatgatgcttttaatcaagaaagcagctaaaagtataccaagtatactaggaaatcaatgtgcttgttttcaaagagacttggttaaaaccaaatttgttatgccttaacatgtgcctttggatctgctatgtgtctctcaggatatgttagtcttattttgatgaaagcatgactgcagtgagaaattatgttctgtctccctaaatatgtcttgcaatcctactttgtattgcaatatatactacaaagaagattccccaccaagaaaaaagttatttagaaacataatgataacttgtcagaagacagttttgagtgtatgtatgtttgttctccttcagtctgcatcgaattagagctgattactctattgacaaaagcagggatggcttggactgacataaatctaacttgctttagaaggactagaagacattaagaaccgattcaaagtgcaatgcaatggagattccttcctgcgaagagtctagctaatgttgaaatgacaaaacagaatcttttgttttgtttttaattcttctctcatacattacatccagactcagttttccctccttctactccttccatcccccacatcccctttcccccagatctgctttccttcagaaaaataacaggcctcccagggatatcaatcaagtatggcataacaagttacattaagattaggcacaaaccctcacaacaaggctagacaaagtaggagggaaacacagtaggagggaaaggatgccaagagcaggcaaaagagtcagagacacctgcaatatgttaagttccagaagatgatctgcatacttgagtgcatgtatgtgtgtagatccatttgtgttcatgcttgtggaatacagagagcagaagttagcctcagatatcattcttaaggtgctgtccatcttaccttttgggaaattgccacactggcctcgagcttgctgaatgtgttagactggctgggcagcaagttccagggatctgcctatctctgcctccctagccctgggatttcaagtgtgcccaccatgtctgccttttattatgtgggctctgggaaattaaactcagctccttatgcttgcatagcaagcattttacaaggtgagtggtttttacagccccaaagatgacttcttaagaatgaataggaagtgtcttcttatataattaacacaaggaatgcaaacagtatacactgaaacttcatcataaggctgtcttctgtttaatttttaaattatatattctaagaaaaaatattttcagcattcatgcctttcactccatcttttttaaagtgtggagatgcatcaggatctctctcaggttggaaattattgaaaactatgttctcacaacatctcactaaaggagtcataatggtgcagggcacatatgggtcaaggcttaataaaactcttgtaaccactctattttactttaatattttatttgtttcatctcccttgttttttgtctctcaccctattaaatctcttgtgttggacaggtcaggccacagttagaatttacttaatagagcttttgcaagagaatgcctcctaaaaggatcaagtacactattttgttaaaaaagaaagtagagtaatccagaaaaatgaaaatcatgccttacaagaatggatatagaaaagcttctaaactaactgatactttttggacggggacaaaatattacagaatagagctcaggggaagaaataatgtgagagtaaagccacatggatcatccaatagtacctcagaagaggaaagcttgacctgaatattcactatctacatcataataaacaaggaggaccctaagagagacacacatggtccttgggagaaggggaaagggacaagatctcctgagcaaatagggagcatggggggagggaggagggagctaggagaatgagaagggaagaagaggattggtgacgaggacatgagggagcagaaaggtggagtcagggcaagaatagaagaaaacaagaatggagatagagggagacattttaggtttaaagagaaattaggcactagggaaaggtctggctatctataaagatgataccaactaacaatctaagcaacagagatgaggctaccttaaatgccctcccctgataatgtgattgatgactgacttatataccatcctatagcctttatccaccagctggaagaagtagaagcagacacccacagctaatcactgaactaaactggaatccagttgcagaaaaggatgagtgatgagcaaaggggtccagaccaggctggtgaaacccaaatagctgacctgaataatggggagctcttggtccccagactgatagctaggaaaacagcatgggacagatccagacaccaggaatgtgggtgtcagtgaggagacttcagaaatctatggggcctcctatagtagatcattacttatccctagcatacgtgtggactttgggagcccattccacatagagggacactccttgagccaagacacatgggggttgggcctagaccctatcccaaaggatatgatagactctgatgaccccctgtggaaggcctcaacctcccttgggagcagaaaggatatgtgataggtagggttttagttgggtggggtgataggggaggaggggaggaagagggaactgggattaacgtgcaaaacaatcttgtttctaattcaaataaaaaatatggaaaaaagccttgaagaatatgtacttagtaacttgacaaaatgaagaaactgtgggctagaaaatgtaattattactcaattacttccctaggcaactctgttccacaaaacatgacattaagacatgaacacaggagtctttgcagggaggggagtgttgacaagggtgaaagaagggttagaataattagaatgcataaagttatcaaagaacaaatattaatttttagaaaatactgtatttttgtatttccagttcttaaatatatagctttgggcagaaataaggtgagccctacatggtagtctcttgaaaatgacaggcaggcaccaagagagtcaaaaggaaggtgaattgaattagataagaatggacatttcattctattattctgttcattgtgtgtatgtatacatgtatgtgtgtgtgcacaatgtgtgtgtatacagtgtgtgtgtgtgtgtgtgtgtgtgtgtgtgtgtgtgtgtatgtgtgtgtgtgtgtgtaaatcagaggttgattactgctgtcttcctcaaccattcaccatactattattctatgtgttgtctttctgtagcagggggagagcatgctttatctattatttgtattggaataaagggaaacacggaacaaattcttgtatgaacttgtttttctggagcaggtagaaaggatagcctggaaaaaatgaggtaacatgctcctttaagtatgaaactataaatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctccctctctctcacacacacaccaaaacaaaccttgatatgacatgcttctagaagatttgaagttcttttctatgttgtatgttaaaaaatactgaagcttagatttggcttgtagcccatcgttatggataactgtaggggttccatgaaagagaacttcagaagtggaagggactactcatcacgtagtcctgggagaatatgggaagtgtgtgactggaaattatatgatggttatggcaagaaggtgctgtttcctattgttttttgattacctctttctttttttctccattttttaatttgaattagaaacaagattattttacatgtcaaacccagttccctctccttcctctcctcccctacaatacccccaactaaaaccctgcctatcacatactctttcagctccccagggagatgacctacttcttgcttggagtataatcactgccatggaggtgagttttgaaaatgagccaaacagcttgcacatgttaggatctacctggaagagtgatgccctttgcttctgtgtcatggagatgctcagatttggagaaatttgtccatggcattatttcctggtgagaaccccactggccaggttctgatgcagctcttaaacatacttaggggcaacaggtgcacataggaatgtgattaggacattttggaaaagaaaggcaacacagagggtcagttcattgcacatgacctcacttgatggtgtcattcagccattgctgaggaccctaactggctcaggttccattgaaacatgtcttgtgctatttggagtttgtttgtggttattttgctttccagttctatatggttgaaatatcatttccatatttataagtaatgctaccaactttttttttttttggtttttcgagacagggtttctctgtgtagctttggagcctatcctggtgctcactctaaagaccaggctggcctcgaactcacagagatccgcctgcctctgcctcctgggattaaaggcatgcaccaccaacgcctggcatgctaccaacttttatcccctcatcactgccagtaatttttcccattggaagaagccatatcttgttagccttaaggaaggctaacatttttcactgaatctgactagagctttgtcaggaaaagtgtgtggaatgtagaaagcaaactgtattactaacgttgctttcacacacagctcccttaaagacatgcaactcctaaaacataatgatataatctgtaaaatgggtacaaaacatacctagctagatacactgcaaactgatagggagttggcaaaaagcaacaagaaggtataaacatagctgttatttgaaggatcagaaacattgaaataatatccattgacagagttggaaatgagcagtatttccagtcaggtattgtagatttctatgttaggtagaactctaatatcacaacagtgtagatagcacttagcatcatcatatttacctgtccatattcaatatctctgtactagtcaatgataaaacttaacaaacttggaataactgttttaagcaaattagtgtgtaagattcctcaggttttaaaaaatataaatatgacataaaccatgctattaagaaattatatacttaataagaatagggtagacaagcaaacaataatatacaaagggggtggaatatggtaggccattaggctccacacaagcatgtattggtagacactgaaaagtatcaataaaaatatcccacccagttgaatttaccattaacttgaaagtgcaaggctctgttctaagttgttacaacagtatgtactaaacacatataattcatcttgtaagtttttcaaatcagtggcaatatttcattgtgatgtttgctgacaccttgtttaatgaagaaaaaatcactgaaaaaaacaagcttcccctgtggtcacttggacttcccccaatgaagcttatctgaccatgtgtttccaacattcagtggattattcgtaagtttattatgaagaggatagtgcacagatttccaggccctaattcagagtaaaaatatagttcttgaatactttgacacaaagataggcccaggattgaatggatataaaagaaacagtgagacttctgtgaaccagttgctccccaacattagctcaagaacacttctaggatctagcacatggaaatcctaaaattgtctgatgcttggccatgagtgtttgagcaatggcttctccctgtgtgatttctatcatcatatcctctgatgaacccccacagatgtgtctgcaggacactgggagacatgtgtcaaataacctggatgcagtgtcagatactttcatactttgactgtaaataatacacattatttgtgtgcaagggtaggctttacagtagatattcatgagatacgttgacacaaaatatggaagggacactttgctctaggtttctagtgaggaatgatttatactttgttccgtttttctccttaacattttatttaccaactgttactcaataaattgaattaatattttgttactgtgcagccaggcagcagatgttatgtctcacaagaaattgcactattgcatcggaaacattgaaatgaataaaggtctattttcttcacatgctatattctgccaagctcctgagaggagaccgcacaatggtttggtgtggccttgagttaaaattatagaaatattgaaacctcagaatattaaaatttatgtgaagctgaatcattgtgtttacagctggctagtaaatcacatttcttacttctctgattttaaggaccaggaacaggaaactagaggcataaaagattaagctcgaaggaattttaaagaatggtctcctcccctttctgccactggtgcctgttttttgttttgttttgttttgtttgttttttgtttttggtttttttgctatactctaccttagtgaggagactctttcctatctgaacatatctgctaggaaggaagtgctaggatccctactaattctattatgatccactgacacaacttgttttcttcaagaataaatagttttctcggctattttatttttaataatgtccatttcaggaataataaattccagtgcagagccactgtttttaaaaggctttggtaaatacattagatggagagaaataggtattcaatgataaagaaaatgttctttctaccagaccaaggttaatgctaacaaggaaacagaaaccatgtcaccaatgcctttgtattaaagctcacttcctcttgaatgttcttgcatatcaatgctatgccaaaggctttcattatctctctggctttgtgtattccaatattttcctgtatgtgacttttttcttgtataaactaaacagatttaagtgcatgtcttttacaagtctgcagatcttcttttaatgaaggtgcccttcagtgcaaagggcctgtttgaggggtggttcaaagatggtgtactctcattaatgctcttaaagttttacttttgatcagagttggcaacataagtatagatcaaatagaaaccaaatctcccctttgagaccattcaaggttcttcactctcttggctctcctgatagctcactgttcttattttcggcacagtggggattagtcctataaggagaaaggtttggtgaccctgggaatgctaactcaaggcaggcagagtaaagaactgttatttagttgactatataatttaagccatttaaccacataagcgtggcaatacattgtaactgcaaagcaaataagtcactcttgtcaaaaatgtactttttttaacttgtgaaattagctatcaattcatatgcaatcctagataaaaaatggagggttcccagatgcactagtgcatgagaatggaagtaattgtttgtggttttcatgagaagattgccagtttgcagcatttaaattacatacaaactggttttcacgtctctaattgtagctctgttgttttcagggagggttgaattgacattgacaaacacagacttataagggatacaaagacatgaaaacagcactacatttgcccccctcacccaaatgattcagtgaatagtgctacagtgttttatttattccttggtatgccaaatttccttttttctctaaggagcaatgctgacttcggtaagttaatgagaaatagttacttcagggagtttgggtaaatacaacacatggcttttgtgaattattgtgtgcctgcttatttatttattttagaagtattgaatttaatataatctcttgtctgtttattttctttgaagtaagaatatgcatttaccttcagtgcttaattggccaggccagaactcatacagatctctccacgatggcattttgggactggggaagataaatacagagtcctataataatattctatgcattactttttgctttaatccctgacttttcctgtgaaataaggccactaacctcttaggcaagaagaatgaaaactggcttttggagaaacaaaacaacaaaacaaagggtaattctgattttgagtttgtagggctaactgaatgtggctgttaattctggtgtacaaacaactgcctcaaaaagagattgccaaatccctcctattcagtatttgtttcctttgaaaaaatagttttaattcttaaaggggcatactgagttaaaacatagttgtgaaaataaacaatggcttaacaagagggagttcgagtatggaaaaggccatattaaaagcagaaaacaaatgaaaaaaattaagaaaacgctttggcatttgggcaagtttacaaaggaaactgcctacattttgcttggcatagcattttgaaagctcccacagtgagaataattagcagaagccatttgtgagtatatttctagaagagctgggccccatgtatgcttgcagattactgggcaagaagaagagttattttcctgcagaaacaaggaggtctttgttacatagtgttcaaaggctctgagggaggcagtgatgtgatacacagcaagctaacattggtgctctcaaagcttgcaacatactcactggtttctgttgctttgtgtcttacctacagtattgctgagagactaagtccaatagagagctagaactaaacagattgtaagatggtaagctacagatcactaaaagagaaacctatcttctgggtggaacagtttagagttggaatgagctattggcagatgtacacatgcagcagtatacaccaggttgaatgttcaacctccaggaggctttataagaacatgaggcagaaggagtagccagatgacccctttctggtccgttctgaagtcctttttcttttcttaattaagttttatttaaatttaaacaatcttattttacatatcaatcccagtttcctctctctccagtccctcattccctccagtatccccactccaccacacctcccaatccacttttcagggagggtgaggcctcccatgggggatcatcaaggtctatcacatcatttagggcaggacctaggcactcccctgtgtatctaggctgagagagtatccctccgtggggaatggccttccaaagtccatttgtgcactagggataaatactggcctccactgccagaggccccatagactgtccaagctccccaaatgacacccatgttcagggggctggttcagttttattctggtcccccagctgttaagtctggggtccatgagatcccactgatcagttcagctgtttctgtgggtttctccagcctggtcttgacccttttgctcatcactcctccctctctgcaactggattcctgagttcagctcagtgtttagctgtggatctctgcttctgcttccatcagctactagatgaaggctccatgatggcatttaagatagtcatcaatctcattatcagagaagggcatttaaagtagcctctccactattgcttagattgttagttggggtcatcctagtggatccctggagatttccctagtgccagatatctcattaaacacataacggcaccctctatttaggtatgtcttgtccttgctctctttttctgttcttcccccaactcaacctttctgatccctcatgttctcctacccacctccccttctctccttctccttccccactgtgccatccttgtttcccagcttctctggggttgtggattttaggctggtaatcctatgctctatgtctaatatctacatgtttgtctctctgtgtctgggttacctcacccagtgtggtttcttctagttccttccacttggctttgaatttcaagatgtaattgttttgtacctctgactagcactccattgaataaatgtaccacattttctttattcattcttcagttgaggtgcatctaggttgcttccaggttctggctattacaaatgatgctgctgtgtatatagttgaacagatgtccttgtggtgtgaatgtgcatcctttgggtatatgcctaagagtggacttgctgggtcttgatgtaaattgatgcccaattttctgagaaactgccttactgctttccaaagtggccactctagtttgcacttccaccatcaatagaggagtgttcccctttctccacatcctcttcagcacaaattttctttgttgtttttgattttagctattatgacaggtgtaagatggtatctcagagttgttttgatttgcatttccctgatagctaaggatgtttagcaattttttaagtgccttttggccatttgagaatactccattgagaattctctatttagatctctaccctattttttgttaatttttttatttgaattagaaacaaaattgttttacatgacaatcccagttcccttgtcccttccgtcctcccctacaacccccacaactaaaaccctgcctatcacatgtcctttccacttcccctggatggtgaggtcatccacagggtgtcatcagagtctatcatatcctttgggatagggcctaggcccacccctgtgtgtcttggctcagagagtattcttctatgtggaatgggcacccaaagtccacacctgtgctagggataaacaactgcaggaagtcccatagatttctgaggtttcctcactgaaacccatctgtaccctctttttaagttggataatttgttgtttaagtgactagattcttggggtctttgtatattttggagatcatccttctgtcagatgtgaggctgatgaagatcttttcccattttgcaggctgccgttttgtcttgttgactatgtcctttgccttacagaaacttctcagtttcaggaggtcacattcaataattgttgatttcagtctttatgctactcctgttatgttcaggaagtggtctccagtgccaatgcattcaagggtatatcccactttctctattaagaggttcagagtagctgcatttattttgaggtctttgatccatttggacatatgttttgtgcatggtgatagatatggatctatctgcaatcttctacatgtcagcatctagttatgctggcaccatttgttgaagatgctttcttttttccattgtataattttagattctttgtcaaaaatcaggtgttcgtagatgtgtgggttaatatcagggtcttcaatttgattccagtggtctacctgtctgtttttgtgccaataccaagctgttctcattactatagctccatagtagatcttgaagtcaggtatgttgatccctccagaagttcatttattgtacaggattgttttggctatcctgggtattttgtttttctgtattaagtcgaatattgttctttcaatgtctgtgaagatttgtgctgggattttaatggagattgcattgaatttgtagactgcttttggtaagattgacatttttactatgttgatcctaccttccatccaagagcctgggggatctttacattttctgatatcttcttatcataacttcttgtcatacaggtctttcacttgtttggttagagttaccctaagatattttatgttgtttgtgactattgtaaagtgtgatgtatctctgatttctttctctgcccatttatcatctatatataggaggactactgattttcttttagttaatcttatatcctgccactttattgaaggtgtttatcacctgtaggagttccctgatagaattttcaggtcacttacataaactctcatgtcatctacaattagttaaagtttgatttcttccttttcaatttgtatccccttgatctccttttgttgtcttattgctctatctagaacttcaaatacaacactgaagagatatggagagagtggcagccttgtcttgttcctgaattagaaaaattgcattgagttgctctccatttagtttgaagttggcttgctgtatattgccttaattatgtttagctatgttcctttaatccctgacctggtcaagacctgtataattaaagggtgttgaattttgttaaagcctttttcagcatctagtgagatgatcatggggtttttctttttcagtttgtttatatggtggattacattgatggattttcatatgttgaatcattcctgcatctctgggatggagcctacttgatcatggtggataatttttctgatgtgctctttgattaaagttgccagtattttattaagtagtttttttttttcagatttttttatttgaattagaaacaagattgttttacatgacaatcccagtttactctccctcctctcctcccctaccatctcccctcccaactaaaaccctacctatcacatatcctttctgctccccccaggatggtgaggccttccatggggggggcatcagagtctatcgaatttttttggatagggcctaggcccatccccgtgtggtttggctcagggagtggaatgggctcccaaagtccacacctatgctagggataagtactgaactactacaggaggtcctgtagatttccgaggtttcctcactgaaacccatgttcctggggtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatagatccacctgcctctgcctcccgagtgctgggattaacgcctggcatgattaattttgttagcacacattggctttcacgggcctgtcactgaaggctgctcatgtccactctctccacctcctctgttctcctcccttgcagtccctttctgcttgtcctatgaatgaggttcacattagggaaaacgagatccacggaggagacagaacacacagtccacggcccttcacccacagatcccatggaggagagagaacacacagtccacggcccttcacccacagatcccatggaggagagagaacacacagtccacggcccttcacccacagatcccatggaggagagagaacacacagtccacggcccttcacccacagatcccatggaggagagagaacacacagtccacggcccttcacccacagatcccatggaggagagagaacacacagtccacggcccttcacccacagatcccatggaggagagagaacacacagtccacggcccttcacccacagatcccatggaggagagagaacacacagtccacggcccttcacccacagatcccatggaggagagagaacacacagtccacggcccttcacccacagatcccatggaggagagagaacacacagtccacggcccttcacccacagatcccatggaggagagagaacacacagtccacggcccttcacccacagatcccatggaggagagagaacacacagtccacggcccttcacccacagatcccatggaggagagagaacacacagtccacggcccttcacccacagggctgccccccacattcgtgccctgtatatatctggaaagatttagattctgcatgtgagaaaatgggtggcatttgcctttcttttgtccccattaccctgctgtttcccaggaccacctcgaccttcctatctctggctctcctcttccttagagtgcatgaaagaaaacacaggacactgtctccatagtaactccttgcaagatggagagtcagcagagggtttctcccactctggagactgctgtttcctttgtttgcggaaggggtttacttcaccatttgtcacctctggctattatttactaggctagtagtctcttgtcagtttcaggtcttagagagaagatttttatcacttttgcatgaggtgaaagacaagttagttccagccctctccgtgttggatatgtagacttggcagcacctttcatttgaagaagcgctctcttctccagtgcctatgctcgagcatctttgttgaaaacctggtggctgtagctggcctctgtgccagtgatatgctgtcgctgttcctatggctctgtggtgtacttcaagccaggaattacaaaacctcccccaaattgctctgtctacttagggttgctttagctactcagaatactttgtccttgcatgcaagttttaagattacctttagctctataaagaatgttaatggaaggtaataataatgacactatttccagactgcttttaggaatacagctattttcacagtattaattttgcaatctcataagcatgggagatcttttctgtcttctttagtgcagtttctttttaattgtaatatttttcatatttatttttatttgtgtgtttctgtgtacatttgagtgtccatgaagaccagaagaggatgtcagattcccgggatctagagttacaggtattataagccacctaatgtaggtactaggaactgaacccaggtcctctgaagagctttatgtgctcttaaagagacattcattgacccggtgctggtgctacatgcatttaatcccagcactgggccagcctggactatagagttccagacagctaaggctacacagacaaaccctgtctcaaaaaaacaaaagaaacaaacaaaaagagccattcattccaccctatcgcagtgtttttaaattttccattgtgaaagtattattttttttattaggtttattcctggcatgcaggggcagggagtatattggtttctttgttactgttgcactagggactgaactcacggtgtgaatgtgctagtttagtacccagcctccccagggatgtgtgtgtctatgtgtatgtgtgtgtgtgtctgtgtgtgtatgtctgtgtatgtgtatgtctgtgtgtgtctgtgtgtctgtgtgtgttctggcctggagtcgggagcgggcaggagctcactcacctctattaagtagttttgaatcaatgttcatgagggagattggtccttagttctctttcttagcagtgtctttgtgtgatttgcataccaaggtaattgtagccttgtaaaaagagcttagcaatgtcccttctgcagctattgtgtggaacactttgaggagtattggtaatgctttttctttgaatttctggtagaattctgcactgaaactgtctgcctcaggtgttttttttttgtgtgtgtgtgtttttggttgggagacttttgatgactgcttcgtttttagtaggggttataagtctgtttaaattgcttatctgttattgatttaattttggtaagtgatacttatcattttctctaaattttttatttttgtggagtacagattttcaaagtatgacctgatgattttctggattttctcagtgtctgttggtatttcccccttttcatttctgattttattaatttggatgttttttctctgccttttcgttagtttggataaaggtttgcctatcttgttgattttattgaagagccaactctttgtttcattgatttttttgtgtcttttttgttgtttctacttcattgatttcagccctcaatttgattatttcctggcctctactcctcctgggtgagtttgctactttttgttcttgagctttcaggtgtgctgttaagtcttgtgactattccatagttttttttttttttttaataggctcttaatgctatgaagtttcctcttagcattgctttcaaagtgtcccataagtttgagtgtgttgtgccttccttttcaatgaatcctaggaagtctttaattttttctttatttctccctttaccaagaagtgatgcaattgagcgttgttcaaattccatgattttgtaggctttctgcaatttttgttgttgttgaattataactttaaagcaaggtttggtaagatacaggagtttattccaaattttttgtatctgttgatgtttgctttgttgccaagttgtggttaattttagagaaggttctatgtggcactggaaagaaggtatattcctttgtgtttggaaggaatgttctatagatgtctgttaaacataattgagtcacaacttttgttaattcctttatttttttgttaggtttctatatggtagtaatgtccactggtgagagtgggagtgttgaagtctctcaccataagtgtgtgtgactttagatgtgatttaagttttagtaattttttttatgaatgtgagtgcctttgtatttggtgcatggatgttcaaaattgagaattcagcttgatggaattccctgtgatgaataggaaatcctattctttatctcttttgattaatattagtttgatgtttaatttgttagatattaggatagctacaccagcttgtttattaggtccatttgattggaaaatcttatcccaaccctttactctgaggtaatgtctgtctttgaagttgaggtgtgtttcttacatgcagcagcaggatagattctgtctttatatccattttgttaggctgtgtctttttatagatgaattaaaataattgacattaagggatattatgaccattgattgttgattctttttagttttggatttgttggtggtggtattatgtatgtgtgtttcccttgtttttggcttttggtaaagtgggattatctattgcctatgtttttgtgagtatagctgacttcctcatgttcgagttttacttccagtactttctgtagggctggatttgtgtatatgtattgcttaaatctggttttgtcatgggatattctgttttctccatttatagtgattaaaagattgaaagcttttctgggtatagtagtctgtactggcatccatggtctcttagtgtttgtagaacatttattcaggaccttctggctttcaaagtttccattgagaagtcaggtataattctgatatgtctgcctttatatgttacttggcctttttcctttgcagctcttaatattctttctttattctgtatgtttggtgttttgattattatgtggtgaggggactttttgaggttctatttggtgttctataagcttcttgtactttcataggcaggtccttctttaggtttggaaaattttcttctatgattttgttaaatatgttttctgtgcctttgagctgtatgatatacataattaaatacaggttatatagtcacctataatagttagaacttataattaggttagttaggtcttctagatatacagagatgtatttgaattggataggtattcttcaagctttcaaagacctacagaaatatggcatttaaatggtttaggatctttcttggcagtgagacacaactgctcctggcactgaggagacaccatgaccacatcaactcttataaaggaaaacatttagatggatatctgcatacagtttcctagtcaagaaatattcagccataaggatgaaagagaagtgaatacaaagagggcaggtacgcatggcccacaagaaagtgattgctgaacttacaaaacaagacagtactgaagggttcctattgaaatggagaagtgtggcagagacactgtggcctataggctgaagatggatgccccaacgttacagaggaactttgggtgactgtccaggtagcgagatgttctgtcaattctagagtttatatattatccttctgtggtatttgatagagttgaagacagttatggttatagttttcttcagttattataaaagataagttacccttctttttatttagacaagaggagatgatgggggaagtgtttctgtgtatgtgtttgtcttactggatgataaataaaatactgtttggccaatgaaacagcaagttagacaggactaggagtcaagaaggattctgggaaatgtagcagagaagtggtgatccaggcaggaagtaacatagcaaggagactcatatttaagaaaggagaaacaggaagtgtccctttttgccttcgcctcctccagtggcgctatgtgagccactggcaagagagggtgccagtggaagacatcccgtataagtcttataaaatatatacatttatgataattaagactgagctaacagatgagaaatcctagtcattggccaagcagcatttgtacctaatatgtctctgtattatttgtccatccatttggcgggcagaactccagtggctggcgagaccacccacgtggcagtagaactcgggcagctttggtggaaagatttatcgtaacagagaaaccataataggaggagacattttagttttacagagaaatcaggcactagggaaaggtttagagatctacaaagatgacaccaactaacaatgtaagcaacagaggagaggctaccttaaatgccctcccctgataatgtgattgatgactgacttatatgccatcctatagccttcatccagcaactggtggaagtagaagcagacacccacaactaatcactgaagtcaactggaatccagttgcagagacggatgagtgatgagaaaaggggtcctgaccaggctggtgaaactcatagaagcagctgacttgaacaatggtgagctcttggttcccaaactgatagctgggaaagcagcaggggcctgagctagaccctagcaacgtcggtgtcaatgaggagacctcggaaatctatggggcctcttgtagtagatcagtacttatccctagtgtaggaatggactttgggagcccattcctcatagaggaatactccctgagccaagacacatgggcttgggcctaggccctatcccaaaggatatgatagactctgatgaccccctatggaaggcctcaccctacatcaggagcagaaaggatatgtgatattagggttttagttgaggggtgggaggggagtaggggagggagagggaactgggatcgatatgtaaaacaatcttatttctaataaaaaaatacctttttctcatctccttatggaacattctccaaaattgaccatataacatggtcataaaacaagccttagcaattacaagagaattgaaataaccccatgtattttatgagatcattatggattaaagctggaattaaaaaacaacagaaacaacaggaagcctacaaactcattgaaactgagcaactctcttctgaatgactactgggaaaaggaatagagaaataaattaaagacttcctagaattcaatgaaattgaatgctcaacacacccaaataatcaaactggagactgcagtcagtaaaatagaaagaaaacaatacaaagagtcaatgaaacaaagacttggtagagttggttctttgagaaaaatcaacaagataaacaaaacctttgttttgagaaagattattcaaattaacaaaatcagaaataaaaaggggagcctgccaatagacaggaagaaacccaaagaatcaccaggtcatactttaaaaacctgtgcttcacaaaattggaaaagctgggcattggtggcacatgcctttaatcacagcactcggaagcagaggcaggcagatctctgtgagttcgaggccagcctggtctccaaggcaagtgccaggataggctccaaagctacacagaaaaccctgtctcaaaacaccaaaaaaattagaagaatctaaataaatgaataattttctcaatagacagcactcaccaaagttaaatcaagatcagataaacaacttaaatgtacctataaccccaaaggaaatagaaccagtcattaaaagtctcccaatcaaacaatacggggccatctggttttagcacagaattctaccagagtttcaaagaaaagttaatatcaatactcctcaaactagtccataaagtagaaacagaaggaacattgccaaattcattttatatagccacaatcaccctgataacccaatcactcaaagattcaataaagagaatcacagaacgatttcccttgtaaacgcagatgcaaaaatcctcaacaaaatactcaaaactgaaaccatgaacacatcaaaaggatcatccaccacaatcaagtaggcttcaacccagagatgtagggatagttcaacacacaaaaatcagtcaacggaatccaccttagaaacaaactgaaagaaaaaatccatatgatcttcactagatgctgaaaaagactttggcaaaatccatcacccctttataataaaagtttttgatagattagggatacaaggacatacataaacaaaataaatgcaaattacagcaagtctgtaggcgacatttttaatttaaatgaagagaaactcaaagtaattctattaaaaacagtaataagacaaggttttccactctctccatatatatccaataaagcactttaagagcagtaagacaattgaaggagatcaaggaattacaaattggaaagaaagaagtcaaggtattgctacttatacatattatgatagtatacattagagacatcaaaaattctactaggaaactcctaaagctaataaacactgtcaacaaagtggctggatataagagtaactaaaaaaatagtagccctcctatatacaaatgacaaatggactgagaaagaaatcagggaaacaacacccttaacaatagccgcaaataatataaaatatcttggttaactctagccaagcaagtgaatgatctgtgtgacaaaaacttcaaatctttgaagaaagaaagtgaagaaggtatcagaagatggaatgatctccctttctcaagaattgttagaattaacaccatataaatggtcatcctaacaaaagcaatctacagaagtctaccaaatccccatcaaaattccaacacaattctttacaaaccttgaaaagaaaatactcaatttttatgtggaaaggcaaaatacccaggatggctaaaacagtcctgaataataaaagaaaggctggagctatcaccatccctgatttcaagcagtgctacaaagctataatgatgaaaaccacttggaattggcataaaaacagatatattgatcaatggaatcaaatcaaagacccagacataaagccacacacctattaccacctggcttttgataaagaaaccagagattcactatggaatgaagagagcatcttcaataaatggtgctggtctaactggatgtctgcatgtaaaagaatagatccatatttatcaccctgggtaatactgaagtccaagtggatcaaagacctcaatgtaaaatcagatacattgaacatgataggatagaagtgagaggggggactagtcttgagcacattgtcacaggagacaacttcccagaacattaatagcataggcattaagaagaaaaaataataaatgggacctcatgaagctgaaaagcttctgtaaggcaaaggacactgtcaatagggcaaatgtcagcctacagaatgggaaaagtttcaccaacaataaatctgatagagggctactataaaatatataaacaattcaagaaattagatatcaacaaaccaaataatccattaaaaatggggtttagagaattctcaaaaaggaatctcaaatagctaagaatcacttaaagaaatgttcagcatccttagcaatgagggaaatgcaaatcaaaactactctgatattccctcttacccctgtcagaatggcaaagatcattaacacaaatgacaactcatatggggaagatgtggagcaatggggacagtcataccttgctggtgggggtgcaaacttatacagctactatggaaatcaatgcttcatcagaaaattgggaattgatctatctcaagacccagctatactactcttgggcatataaccaaaagaatctccattcttccagaaggacatctgctcaatactgttcatagtggtcttattcataatagccagaaactgtaaacaacccagatgtccctcaatcaaagaaaggataaagaaaatgtggtacatttatatttatattactcatttgttaaagaaactgaaatcatgaaatctcaggcaaatggatggaagcagaaaaatcatccccagtgagataacccagactctttaagacaagcattgtatgtactcatttgtaagtggtcattagctgttaagtaaaagataacagtactgcaatccataagcccagagaggttaagtaacaaggagcattctaggggagacacttggatctcactagaaactggaaactggaaatagaatgattttgtgggtgaattggggataggtggggatgggaactggaaggatcaggtattggagagggatttgtggagagagtactaggagagataactagaaatggggaaacattttttgggggacatgtaaacttcctggaacttatgagaatgacgctaacaaggattcttcctaatagaggatatggagactgaaccagccatcttctgtaaccaggtaaggctttagtggtgggaatagtgggacaccatcccagccacaaaacctttgcctacaacctgccctgccttgcaagttatgctggagaaatggtggctcagagcttgtgggagtgtctaatcaatgcctggtctaacttgagatctatgctatgagaagaagccaatgtctgacacatggaagctggatggtcaattgaggcagtggtctgacagtctctcaaatgcgcgaatgacaaggctctgctcctcaacctggacagattgcggtttgggacagctacatacctgaactggggccaccctcctcccgaacgcaaatgcagagccaccagatcctggctgagacctatgctggaagctgagcacacctggttcatggatggagtagtttcctacaggacggcatgtggaaagctgggcggcagtggtggacagacaaaccatcgtatgtgccagcgctttaccgggaacttcagctcaaagggccgagcttatgccctaacccaagcactcagcatggctgaagatcgcacagagtcaacatctaccccagccgctatgccttcgctacagctcacgtacatggagaaatttactgaagacagggcctcctgactctttcaagataatgggagaaggacatcaaaaataagactgagatcctaaatctcttacaggctctcttcttgccacagaaattgagcatcatgcactgccccggacaccagagaggaaatgacccggtggccaaaggaaactgaatggctgacaaggaggccagaaaaccagccttgggccctcatattctctcctgttccagccccacgttcatcacaaggattcaaatacatagaccactacttagagacagtccagagcttgggggctgactatgaccagtaggcgaaggtatggtgccaccagggcaaggtcttgctaccccaaaaagcggctaaggaacttctgtctcagctacatcgatggactcatcttggacacaggaagctcaaagccctcctaccgcaagaagaataaatatactatattcataaccttaacactctccttcagcaaatcaccagtgcctgcactctctgtgccaaagtgaatgccggctggctcaaactgcccgagggaaccagaatcagaggggagcgaccagggaccaactgggaagttgatttcaccaaaatcaaatctactacagtagatttgtaggaaagctgccgcccagctttccacatgccgtcctgtaggaaactactccatccatgaaccaggtgtgctcagcttccagcataggtctcagccaggatctggtggctctgcatttgcgttcgggaggagggtggccccagttcaggtatgtagctgtcccaaaccgcaatctggtagcttcgggaacaggtaccttctgatttttatagacaccttctcaggatggactgaggccttccctgccaagcgtgagaccacccaaatagtagtggtcaagaagatccttgaaaaatcttccggaggttcggactaccaaaggtaatagggtctgataacggaccctcccttgtctcccaggtaagttggtggccaaaacactggggattaattggaagctacattgtgcatacagaccccagagctcagggcaggtagagtggatgaacagaacgattaaagagaccctaactaaattgaccatagagactggcactagagattgggtacagctcctgcccatggcactattccgagtttggaataacccctcggtgcatgggcttatgcctacctgttgactccccatccctccaggcccagctatgtgctctttagattattcaaaaccagatctggaagccactggatgcactgtaccaggctggaaatcctgcagtgcctcatcccttccagattgggacaccgtgtacatcagacatcaccaatctaagactcttgagccccgttggaagggcccctacactgtgctattgaccacttgtatggcactcaaggtagacgggatcgctgcctggggtcacgcctcacacgtcaagaaggccggggccagtggggatccggctgatgacgaggcactgtaatggagactgcagtgcacccaaaacccagtgaagctaagactttttcgatccttaattatcttgctatggttgatgctttttcatctccctgctctagttaaaggaatcccaggaatcccatatgcccccagcagttaacctggcaagtgatttcccagacaggtgaggttgtctggtccacctctggccattatccacctgacacctggtggcctatcctcaccccttatttttgtcaactggctgccggactagaaacttgggacattcccacttatggagcagactcccttgaaaaggtgatgcccaggacaaaggacagatggttctgggactgtagtaaccccaacacccgatgccacctggcacaattagatttctatgtctgccctcagcagggacagcccagggggtcaggaatcgggtcttatcaggaatatttttgtaaaaaacagggatgtaaaaacactgggaatgcctattggaattcaagttcatcttgggatctaataaccgtacaccagaataacacccctccccacttaggcagagaagactgcttttctcccatcatctggggggattggacctatgagtccaattgcctcactttgagaattgccttcactgcccaagggaagaaagattatgttgcctggataaaaggcaaaacttggggattaaggtggtatatgaagggatcagataaaggagtcacctttaaaatctgcctcgaaatacagagctctactccaggagccatagggcccaatccagtccttagaaacccggggaccccaaagccccccacaccaaaagtctgtgttctggacaataccttggtcccaatcgctaccagtccctcccacaccactccctcccaaggagaaaatgttccctctgctgagtgacgaatttttaacttggtctggggagccttctctgtctttaaccagactaggccagagatgaccaacccttgttggctgtgccttgcttctgcacccacctactacgagggcatagccaccctaggggcattcactaatgccactgattcatctcaatgtgactggggagcataccatagactgactctaacacaagtttcaggaaggggcacttgcctgggatctctccctcggtctcaccaggacctctgcaatcacaccctcctgcaacctgagaccaatatgagccccacatacttgctacctagcccaggcctgtggtgggcctgtagcactgggctcaccccttgtatacatacaggagccctcgaccaggccaaagatttctgtgtgttagtccaactgatgcccctcgtattttgccatctggcagagtatctggaagaggtatatagttctcaccagacccgataacgaagagaacttgtatctctaactttagctgtcctactgggtattggggttgctgcaggggttggcactggaactgtgatcttagtccaagggtcacaacaatataacaaactcagacatgccataacagaggacctaaaggtattagaaaagtcagtgactagactggaggaatcgttggccttcctggcagaagtggccctccaaaacctgagaggattagacttattgtttataaaagaagggggagtctgtgctgcccttaaagaagaatgttgtttttatgttaaccataaaatcaggagatcaaggattccatgtctgaagggaccaggtccccattttggcagccatgacagtaacacatgcttgccatgaccttgccttggtcactagaggttaggtgcctgcctcgaggcaaggaaccaatcagaagttagctggtggcactatgctttacagctctgggtgtgctttactgacaagtgcatagcaatgactcgaagagcatagcaaccaccctgggagggcctatgggccataacaaccagttggccaatcaacacagtgcaagctctccaagcctggaggcacactaatcctgagcctgtgcatacccctagacactccccttatgctgccctacatgatctctatgcagctcctatgagctgtctttgctagccatccgccatggcgggtgggtgaaagaccagaactaacatgggattagctcgttaaacaataaagcctcatgcaggttgcagcaagctttcaaatctgcctggtgatggggtgaccaaggtcctgggctgggaccccggaggcctgagatttccagggttctaacatgtccaagctcagagaaagattggctcaaaggcatagaaggccaaggcccagcagggatggatcagcaggaccccatggttgaccactctggtttccaccctattagggcccctatttatacttctcctgctcctcacatttggcccctgtctcttcaactggctcttacagtttatatgtgagaagctatccatcacccaggcccttgtccttactcaacagtatcaagctaaaccaaactctgaggccccctgaggtcttaagattaaaacctcacaaaaagaaaaggaaggaacaaaaattaacagaagaagcgagatgaggccagtgtgtagttcagcaactacactcttagaggggcataaatagttaaattccaaatgtttcagatgaccacagacctcctggacagttcatggagaaacccctgacagattaccccaccaaccgctgagtcagaagctgataggcaagatccttgtgaaacaagggccagtaactgccttttatttaggcaagattgattagcacatcctgaggcctgagggttttataaccggtgggacaggaggccatctgattcccagccctcccctcaggacaaagggcctcctaggaacccatgactctggtcacatactcaagatcagagggtcacagcccctccctaagcttgtggtttttgcctttaaaaacacctgtgcctggaaatcggggcttctctctagcctgcgcgctatgtacaaacgttcaccattcattaaagcctctttcgtgttgcatcaactggacgggatattgagttcttgggcgactgttcaggttggagattcctcaatctgagggtctttcacgcatatgggaaatgtgcagatttctgaggaaaggcaactcagaactgctcactggtttattatcaactccttagataaagtgacattttatagaaagaaagaacaagtttcatcaaaattgactttcaatttcatagatgcataattaatttgtcctggaatgtaatggagatattacacattgtcatgatttatatccaccaactttatctcaagatggtttgtcagattttcctattttcacatttaaaataatgcttttttgatgtctagagtaagaggatatgctcaaacttttaaataaaagtctttggctataaacctagagtcatagtttatatatttaattgtaatctgtgtaatctgtctgtcttctctccctctctctatctcccctattttttctttctctctctctgccctctttttctatctcattgcattaagctgtggcctcacatgggcttaacaattgtggttctaggctttagctctgcttttcctttggttccttatttgcttttcttcaaggtgctgcctgtaagctcagctgctgagcacaatgcttgcagagctgttggcatctgtctgcagatcacagtgggaggcactgagaggctgtttcttccttagcaagagaaacttttgcagatgctctcctgcctctttgctacgaactggatcgtgtgcccatcagaagcaacttagtagtcaaaggacaggactgtcctgatgtgtttctaccaaaggattaacactgaaggtctggaaaatgttgagcttctaagaactccatgaaccatagcctgagggtcagacttagatatctatttttgtaaaaatagatttttaggtcacagccaagcccatttgtttccacattgtggaatgatgcatttacattaaaactgcagagatgtatagctgtaacagagaccaggacaactgtaaggctctaaaaatagtgtgtgcctcttcatagagaaagatactgcctcttacataaaatcatagaacaaaactggtgccctacagtcaggaacagaagtggaaaaggtctgataggcaacagtgactattaaaggtcccatttaattcttcctgaagtagcatatgccaatttccacaaagcacatgggcattattatgttcatatagatttcttatgttgtaatttatagcatgtattctattagttattaaagttatggtgtagttgtacacaattccaagatttttctgtgctctggctttcatgctatagtttattgtcatggattaagactatcttttcctttgctttacagaatggagccaagctgacctctaattgtattagcagccatatcacgtcttcctattcaatgctcgacttggccaaaatttacagaatgaattagctagaaagaaactttatgaaggacttattctatttaaatattaatgaggtttttatttttattcagggaaatttcaatctaagaagagaccaatgcagctgaattgtaactattctctaaagaagccaaggaggcatgggcatatgtgaagtccattgttagtgttgtaagtagaagggcgtcagtcagctcagccatatgttccagtttggacttttaaaaccattagatgtaaaggccacattctgcccaaggtaaaccagtaatgtgtaatatagaatatccacttttttaagtagttaatgccttgaacacattggtccataggtttaggagaataaatagcagttgaagtctacagaaaatattcagcccatttagatactgctctaggacctaaggtttaaaatgaaacctctcactcaggcaaaatttctcaagaactatatgctttagtcatgttactttgactcttagagttgataacatgttatcaacccttgtctgacataacaccctcatttagcattgagaaatgctgtaagaaacagccacatgcaatcatgtattgcacagattgtagcagtgttgtagactatagcatgggctctactatgtgaagggtggtattgttttcagcagcatcaaagatggacttttcaagagtacctgggctgttttaaaacctgtcattgatgatagtgtgttctttcccagtatattttaaatatgataatgtgtggactttcaataaataatggtagagaaaaaggaacctctggtggagacatgatcagaaccggatgtgatacccagcaatgtcttcctggacacacaaaaaccttggcagtaggtttttgcaaaaagaaaaaaatgtttttgtctgagctaatcattaaggtactagaagatctagctttcatgttcctttcaaatagttgacagctgaatatttacaggacaggagggggagaaactgattgttgattggatggtgagaagggaaggtgttgtttgggcatacatggtagttagccactttgcaggtcctgtgatgtttgaattgggggaattatcacattcttcggggggggggaatttggagtttgtgaggttatcattcagaagagtctgcttcttctgcacatgtcctttattgaagaacagttcttgaagcttttcagaaacatatgtgctgttacttgggaattgtatgtctggagtccatgtctaagctggttgctgtatagtcactgggcctgtctaggatcctcagcacttagggggaaatcccaggctctgtgagattagattccacacttgatccccgctgctttcccacttgactatgctcaccaggaagcctagggtcaagttcaccatccagctataaaccaattttgcgttctttatgattcaggacttattttcaatttctccaaattctctgtctttaacagcaacagcaacaaaatgttactaaggaaagaattatatgtttataaaaagctttaaactcttttctggtatgggtaaggtacaatttgataattataaatatttctaagatcctgactaagaatttcactagggtctataataagcttttacagttgtcttgtgtagcataataaaccttttgacagattcttcctgtaggattcaagccccaggtaaacacagattagcatgtatattttaaatgtattctggttccctgtcatgtgaaggaaaagctaataaaaatgagacttatacatgggtcctcaccttacaaaattgttcttatttcttgcatggaattttttcttcttgagattcagaaattgtattcaatctggctccttcattctcaggaagctcccggaaacctaggtggtaccagctctccatcgttctctgctagcttttatcacagcagagtggcagacctttcaaggagcttttgagcgagctctctgggatttttctcctgcttttctaaagactctcgacttttgtgtaagcattcagaaccttcgccacgtgaaccacctgacacatagtctttgacacttttctatgtggtatttctataatgcttacgtctgtgaaaaccaatgtctcttaggaaacagctgaaaatgtaaaaaaaaaatttaaatattttaaaagaaaataatatgtagctatcttagcatacccagatgtttcttttataggtagtagaggaggcataggtgtctctgagtgacaagtagaatgaagtaatgtaagtggaggtgggtgtctctgggcacctattcctccttacagaccctctgttctcttacctggataaactttatggagacaacttgccattcttctagaattcacctagttttcacattctgacagtgttaccccctcttctgtatgtatttctcatggcttaaacatttctggatgtgtaaatgggataattaaaacagactcctcattcttatgtttcctattcgctctaattgaacagctgtattcacagagtgacatttaatagatagatcgaacctgggccagaagataatatgaaagataatagaattcggaccactttcatttcaacacactcccagaatagctacaccacatgaataaaaaatagtggtgggattagctacgttaacagaggcagtgataaacctgaacatgttttaggaatcaagtctaggataagggaggatatcagagaagaaaggacacatgaaaatatttgaaggaaaaaagtttgctcagtgaagaaaagaaaatgcaatgtatacatctggtatatacagcatgtgcatgtgtgtgtgtgtgtgtgtgtgtgtgtgtgtgtgtgtgtgtgatggagggagaattgttaaggctatcatggaaaataagtaggaaggcattagatgcaaactaaactatctgtgggttaaatggctgaaaagtataaagtggtttaatctggtaattagtgatagcagactgaatttgtcatgatcgatggtcttctggttgtttgaggtctgctttttatatttttgcttaaaatatctcaaattatattgttatttatttgttttgtatttatatgtgcatatatacatacacagacacactcctgtgcatgcacaggcacatacacacatacatgttctagtgtatttgttgaggtcagagaacaacttacggaagttggctctctccttccactgtgtgtctcctggagatcaatttaggtagtcaggtttgatggcatgtgcctttacctgctgaannnnnnnnnnnnnnnnnnnnnnnnnctatggagaatgtctgtgtacagtttggtttagacaacttgtactaaaatgctcactactcagagccttcacagtactctgacttttgtttcagtggcatttttgttcctggttttagtgacctccacctatgtggctccccagataggcaagctgtgatttccttctacaagtgttctcaggttctggaccaggacagttgtcgaacttctcaatgatcataggggtcacagacacccagatatgtcattagtcagggtgattgtaggagtcacagacacccagatatgttattagtcagaaaaggaaatataaacaatgatacttgtgttacttctttcaagataatgggagggtgtattaatctcatgtctaattctggcattttcctatatgttctcaaccatgatgtaagtgcagcttccttaggcctgtggagaattaactttttccataacatattaatcacgtcaagtatggtcattcagtggtcagaaaatggatcccacaaatgatacacacacacacacacacacacacacacacacacacacannnnnnnnnnnnnnnnnnnnnctgttgtaacttcatgtagtggagagagagagagagagagagagagagagagagaatgaaatatgtggcatgtgtttctccttctctctctttctctctctgttcatcagataccttggagcaggtgttgctggagtttgtaaactactcagcgtagatgcttggatctgagctgtggtctttgtgatagagtatcaccacccttaactacagaaccacgtctccaatgaaaacttgatgtaaatgtggttaacatttgcttagaacttttggtaatttttcccttcccttctgtggggacacattggctccactttctgcttcttaagaaatctgtgtgaaaaggcagatcccagatcattgcatactattttattatttagaatacaagtttttgtctatgagcctggctctaagatgacaatgcatattagagccattcaaagaaagttgggtagaggtacacattgtacaggtttgagaagttaaaaaggaaagccacagatatagttacatagttagggacagtatgctacatcttacacctctaagcttgaggaaggagccagactgcaatggctgccacctgaatggagatgaacttgtcatagctgttgcctttcctgttttcatcagggaataggcatctttaagagatcttggtgaacatatctacctctgttcgatatcacgtcctgtgagaaagagacaaatatcaaacatttgacatcacagcctgtatttgacatttatctctttctcacaggacattcagctgggcaagtccagggtaagaatttggtctggaaggtcattgaagaattttaaaatttatgtttttagcatatttttttcttggtagagctaagagaacttgtaactgattaaaaacaaaatctgatagaaattgtttaataaacagaaagagaagtagcaatctggatgagatgtttggtaagaaatcaaagcagttggcatgatttctgttcatttcactcttattctctgctaactttgcttagttcaactagaatagcttggttgtgagcatggctctgtcatcaacttggcctgggcagagttagttgaagaaatcacaatctgtgtgcatccagatgcatgttactgggatgaaactgggagttgggggagattatattgcacaatgtgatacagaaacatagtcatgtgtgatttcatagctaaaatatttaaacatgtctctgttgggttaattttctacttgttagcctagatctgaattgcaacactttttatacaaaggctaggtagtaaatatttcatgatttgcagtgcagatggcctgtcacaaccactcagttctgtcattgtcacttcaaagccaccacataagggaatgggcatagctatgttgcctttaaaccatattgacaaaaatagacaggctggatttgatctgcaggctctactttatggacccttgatctatacctaaactttgttttctgctcaagtaggtatcaagaatgcctatattcttgtaagtttgctttaaactgttacatgtttaaatgtattttgctttattaaatatgtgagatatttaacagataatagcattattaggagcttagtcatagccacaacaatgaccagcaagagagggtgactgccaagtaggtatcatggaacatcagatattttgtggcatcaaaacaaaaattctcttgtacctcatctttgtatcattaaacatatgttacatagcataaaaaaatataacacatcttcaactaatattccacaacatgtaattatttgaaaatttatttattcatttatttatttatttttgtttttggtcaggatgttttaccacaggaacagaaatagaattaaaatacactttctcttctttgaacatgttgtagttgttattaaaaggaaatagtcaggcaagccgatagacagacttgatgagtaggggacttacttaatagacttacatttttccttattaaataaactttacacagactcattcctgagtctaggcacttagctttctttgtttaaaagcatctcagaaaacttgcagttttaagttctttttctactcctttgagaagtaaatcttatctcaacattggtagatttatagccaaggaatgtctttgtcaagaacctgtgagacatttatttcttcagaatacagtcacctgggaagatagggaagccacccatcacttacagttttcctggaaagtagatgcttaactttgatcagcaccaaatatctatcacaaatagactagtaataccaatcagcatcttctcatgagttgctctagcctctgttcactactttaccatatcatttaaaatctcttctgcctctgatgtcaccagatgatattcagcacctttctcctctaccatagtcttgaatgacatggtccttgcctgttgtaacttcatgtagtgtgattttttttgccttgctagcatctatgagtcatcttggttgcaatgaatttgagcctagaatgttagcttggttgtatttttgcagcagtctttcttagacatttagtggaagattagactgagaagaaatggaaattcaatgaacaatcactctgttcatctactttcagggagaacacactagcatgaagaggaagctgtcctggaacagagttggaaataactcaatgaatgaaaagacactgtactttgaattgtttagtagacttgtttttattcaattgttatgatctcagtgattctttctgatgttggtgttccataaacctctgtttctgacagaacagaatgtcacaacagaacatcagactaacttatagtaattgtgggtcctggctggaaggacacatgttccagggaaagcttcatgttttcagtgtctcactttgttactgaaaaagggaaaaatgaaactactgctgcaaatgtgagatttttaaaggctcaaggagaaggcaatgattttggaattcctatttccagaagattaaaagtgtccattcagtcatgcatgaacatacacattctctctaattctcactgaaccagcaacatgtgattattcttgatcttggtgaactaggaagatttgccttaggtagtggagtgaataataagccatgaagacaccacatgaaatattgtatttgtgtccacatcatatgtccacaatcaatcagtattctttgaagatgataatttgcaatttccattttttttgttaccttgaaatgaagctcttttgagaaatatcctagatcttagcattcttcaacggttcctctaattcatagggtatttcatttctggagatggaaggaactccttttggttgagtaaagtttcataaagtaagactgtcagttatccacattggacatgtaaggccaatccttatttaattgacatgagaatttacttagctgtcatcttcaggttaactttgatattggtagaatatttccccagttctctggaccttcagtacaatgagtaacaggcacttcatatccatgtattcatccaaaattactgaatacctcttagagcacagactaccctagacacagaataaacaaagtgattcagaagacttactgatttcagaattcatggaggcagacatatttgcaaacaacaaggcaagaattgtattgtagataatcacagaaaagaggtctatggaatcagtcatctctaggttgctggatttggactgagaccctaaggttgggatgatatgagtcatgtaaaggcttgaatgaaaatgaaccccattcttggatccccataactgttccatctatgtggatttaattaatggcattgtttaacattattttgacaacatttgctttgttggctgagtcttcaaccttcattaaattttgttcctttccattacacttacatttttaccacatagccactgctacttgactcatattttctcacaaacacacattgtctttcttttatggagacaacttgccattcttctagaattcacctagttttctattgtgtggacagaagttttcttttcatcagtttttgatggcagcatccttgtgcttataggtctgatacctaggtttaagcctaacagctcatcacatttttatagagatcaatatgattgggaacagcactacccatggggttttcatcagtttaaatcttttcatcattttccaatgcccattaggatgtatgtattgatggagggcatggaaggaaggaagggaggacagagaaagaaagggggagggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggggagggagaacaagagagagagagagagagagagagagagagagagagagagagagagagcactgtccattcttcatagtctcctttgaatccctttctcctgcagactctgaaattatcaccatttatttccttctagttctcaatttccacaaaggatctccttcacatggacattcagatagccacaaaatctgttctgtcagcctgcctctggtctcttctctttagcttcacaaatgtcttccatcttgagtacttattgctcaggctctagctctgtgttcttggatgctacatggccacatgtggctatttaaatttaaaccccataaattcaaaggcgctgagtcctgtgttttagttgctagatgctgtagttccagtccttgaaagtgagagcttatgctgacatcatgcagagcagacacagaatgtcactattatggtggagggctctgttgaacagtgatgacccaggggaatgaaacaacctccctgcctctaagcactatgagttcccagcactgccaatgtcatcacaacccattccttgttaccaacattaattttttcaaaaggctgatctagatatttgttccctaaaaatcttttgtgggtttctcattaacttcagaataaattcaaactcttggccttgatatccatgatgctgtaagatctaatcttgttttcaagatttcacacaattagcaaatgcttcttctaatgattatacttagatttggaaatggaagtggtgaggctggttctcttgcatgctgttggcaaattgacatctttctagaaataaatatggcaagtgtagtaagatacttaaaataactatgccgtttacttcagtaatttaatttttagtactctaatcttggaatctcactagggatgtcctgtaaaatgcaggctggaaggggttcataccagattaatatttgagaaaaattgaaaatatactaaatgcccatctggtaggaaaatgcttaaatatattattctacattcatgctagtaagtgagtctcagcatggcaactgtgacaccacagaacatcttccatgttgcttctttctattactccttcttcctccatcacttctttactcatacattatgttctgcaaatggtgactccaccttttacacagattattctgcactggtttccctcactgtggattctcaaatgcctacagatgctttctttaacaggagctcagatcatacctccttcgtgcattcatctcgaacttcccacacagagtgcacagctcttttattatgttccatggtacccatgtaacatctaccacaccactcttgcattttagaacttttactcacaatatacaaatcccaaaggcttcgatgtttttgtcttttatcactgtgcttcagtgtgttacatggtacctcgactctttttaatacagcacatttctgactaagtgaatgcagtaaacgaaaaaaagccacacaaacagccatactcacgaatgcctaaatgatttctctaagtccttctttcttcatcttttactctctttcttaaatgatagagttggggaaattgatagaagaaagaagagataaacacagaaatgaactagaggaatgtcaaaggtttaattttgtgttattgttgatgctaatcctctccaggctgtgcaaactttgttcagttaagcaaatactcccgaagacaaagattttatatttactgggaaattcacagttgcgagtgcccatgtgtttttagtgtccttaggaaccttagcaaataactaacagatttgcatttcctttctacctacagcaaaaggtctccaggtccctcactgaacaatgacattaaataaatactcagaaaacgggacctgagttggtaaaagggatttggactgatctttgattttggagtggattatttactgccactgtaacccagtgaggagaatagaattaaaattacatttataattatatctgtgctcactccatatgcactgttagcataaggttttcaaaatcatgacttttatatatcaggcaggtcaggtaattttgaaacaaatatttaatttctagtgaatctacctcttgtagctgtgggaaaaaagatcctgattcaacactggtaccataaaaatacatttaaaaatccatacatagtatttacccaccaaatcacccaatattatagcatatgtttagggaagaggaacactaaattcagtaaacttatctaattttgtgtgccccataaataaataatgaaaggaaagtcaataaatctaaatctccactctacatatttgtttatataaacttttatttccaaggatttacataatcacttatgtggatcaggttctgctggggattttgtcatcggtccttgtcagagcactttgactttacacaaatttatgacttttgttttacatatggtgggaacgggtgcagggagacggtgacttcctgaaagtgacaaatcaatatgctgggaaaaatatctttagattccatctgaaaaggggagatttgaatatcagtggtactggaagccagaagcattagcaatgagacatgttcagagaagggagctggcaaggtctttggatgctgcacagtatgagctaagattaatgacagagtttgctgacttccttgataatcatttatctaccaatgtatgatttttatttaggtgctggttacttaattattttgaatgtgtatgatttttgttatggagtctcagtattcaagctctgatttctttcatttcttaaaatagtactctgtcttggagtatcaaatctttctcctccctttctgctcccaaataactggcacatgcatggtgccagcaaaatctgaaagaggaagcaagactctcaactgggtcttaaaagcctagtaaagaagtagatttagcctcaactacagtgggagtaagaataacccagcaggaccctacagggtacttgtcctagttatacaagtggtggaagaccaggaggtctttgaaattctctttagatgcaccatggaggcccagtggttcttcaactggggaagcatcctcaatgctgagaattacctcccagttgcctagagtaaattcagtgactgcactccccaggggatttttctcccagaggcattgcaattctctgagagtgagcccactgggtgctttggagagttcttagagcatttccgaatttcccagtgaatttttgttataaactcctggcccacttttgaaaataatacagtatattttttgcctctaaatacatttgattttcattacattctctcagcctgtatcctggaactaggtgacaatttacctcagcaagagtcctctgtccctttatgcattgcttctttggaaagaggcaaaaatcattttgctgacaaagtcatttctaagccttgtctaaactgcattcattgaagtaaccaggttattctcttctctaaattccccatgcattttactccttgaattgaattattccttttctctataaccattatctagtcagtttggtttatatcatctgcattctttcctgatggtctgtttatttcaagcagaaagaagcctcttccttttgatcctactgtctggtcacttcaactaaatggctttgctctatgtaaaacaaaatgagagtctctttgtagatagtcttcttccaatagtctgacttcattagctggagcagataaaaacataaactatagctgaaaaacaaaacttgtttctatgtaaaaccctctctgagcttagaaaatattatcatgcatatttcttaggatatacgctttttctatttgggcatcagctccatcttgtacctgtggttgtagaagaatggctgtgttatttgagttagtaggtgactggccaagaacacccagggaactcacatgttgatctattaattaactgtggcctgggctgaagaagcaggtatctgtgggagtttcaaaataaccccacttcctgagagtctgagtccttcaatacaaggtctgaatgcttaccagttggcttttcagagtgggttggaaaatatagcacttaagaatttcctcctcccgttatggtcacttaccttttttattcactattttactattcctatcttctgaggtagtggttgctcatgatttaaactcataccattccttcacagatgaccctagtcgtatgcggggttggggtgagtgagtgatggatcagttcaaagagtttatcatggaagtttcttgttaaaaaccatcttatgttttctgtgatgtagagaatgaaatgcagtctttaccatagtctataagggtatctatctacgtaactattaatgtatgtatgtatgtatgtatgtatgtatgtatgtatgtatgtgttgggagccaaagaactcagggcttggcatgatatcctaggccatacttggctggccacatagttaacctttacatagcagctccttagaacatcagctcaagaaaagaagcaacttgacccagtcctccacccacaggctcagtcacctaggcaaccctttctggacctcttactcatgaactgtttaccctgccaaacatcctctttgtggcttcctaatatcctgcctacactaacacctggtgcacaaacaacccattctacccgccccatatccagctctattgactatataagctagcctgagaaaaataaagtttgctacttgatcagtatcctgtcttgtggtcgttctttctgcatctcttgtccccattccctgtccctgactctcttgcatcaggttgatgtcctgcaggttggaacatgtatgtatgtatgtatgtatgtatgtatgtatgtatgtatgtatgtgtctacaccatccatctccatatgtccctcactttttgcatatttgagtacttccctgtttctcttagtccagtccttggagtgcattagctgtgagtctgtcttagaatccttttgcttgttttcttgtttgggatactgctacccttctttcaaatatttccccattccagtctgttgctacctctaaaggaggcattgctgtctgtttcagatttcatgcccattgagcttttacattgtcatgtttcttatctccagctgaaatcatcaactctgtcgtacttccaatgccacattccccaccctagagagtgttgccatctcacagaaatcaggcaaaactattagccaatttttcatttgctactgggccactatattgtttgcaactgtatttcacaaatttactatatttgcagttgacattgcctctgaaatgtcatcttttggtcttggtggtagtgataaactggatgtctatgaaagataggaagaatagattttactgtagtgcagttcttaaagcccataatgatgaagaatattaagggaaactgactcatggcttaaatgcattcatggagtatcaaggagaatcctttagttttttatgacctgtatacttagcaatgctaagtaatgttaacaacaaagtttcagagtcatggacacaacctctttcatccagaagaaatgattcctgggttaaatatttttccatatagtactatggttggtggatttgtttatggtttagggggtccttgtctggaccttccttccatatccaaaagttagtaactatggaaagtgttctaagtaatgaagattaaaaagtacaagatcattgattctcatacttaaatagatctccaatgagagaaactcagttacatttatttaaacattgtcagaaaagtctgtattaaaaatgagctgataggactggtacctggcctcttctattgcacacatactgtggcttcccttttactctttgttgaaagagtggactacatacctattagcatctactctgtgaagacagaggtagagataggtagatagatggatagatggatggtggacaggtaggtatagacagaggctggatgctctgagaatcacaaccttgttgagcagaaaaaaattgtcccacttgtggtggttctgggagctgctttactagactgcccttctgggcattttccttgcttgagttgcaaggtcctatgtcatttgtaacatcctgaccatgctcttacaatgatagtgagtataaatattaataattaaaaaatctatccctactaaacttcccaggttctgtcatatcagatttcttttgagatgcgaacacacatttaatttagtttaatatgaattataaatactataacaaaatgaaaagaaatattgtaccatgtgtttctttccattgtaatatattttatctttggccatgaacttcatctcaacaacattaaactaccatgtgtagaatttaattagattccaattttgactataagtatggcttttatgcatttagtatttttaaaatccactaaagcccccaatgctttcatttggtgaattacaatcccactgcctcccagcaggtccaacaaggctttagtttttttcatcacttgtaactgtactccatattctaaaggcaaagagcataaaacctgcaatcagctcattagtggatttggtcattatgctgaaattatacattaatttcacctgaattgctgggtgctaagtaacaaaaaaatctgctctaatatctgctgccttaaaggttattgaattcaatcacattgagataatagctttaaatgaacatttatattgaactttacagatacgtagttcttacattattaaaactggttactcagattataggcacagcatcccaactgctcttcttgcctgtagtctttcttgtctcttgctcattcattatcttgtcactggagttgcttctctatgtcagattgggttatgtgtctccctgcttggatactggcagtgttgccttctaaactatagaatcaaatccaaacccattttcttagtgtctaggctatttataacttcaaatccagctctcttgctaaccttatcttctgtacctaataagttacccacagctgccttctgaaaactggctttaacaaataagccttcattttccttgcgtgcacatagctttgtcttctgtagataggctcatgtatgtagctccatgtctctgtgtgcaagctcatgagcacagctccatgtctctctgtgcaggctcatgcatatagagccatgtctctgtatgaaggttcaagggcataacttcatgtctctgtgtgaaggctcgtgtacatagccctgtttctctgtacaacagtctatacacatagctctatcacagcagggtgattttagggacttagagaaagctttccaaaggaaggattaattaacttgagtgttgcagtaggaactggtattaggagttacctggagaagaagacaggcaacaggatggaggaacttttagggagatagagtgaatgaaaacctgggtggtcagacacaaattgtgtccttgagtatgaatgtgtgtgggttatggacatgcatgatggtagcattcactggtaagccaacatgagggaaagtgggggcaaactttctaaggaagttctattcagctaccacagacatagaaaacaagttttaaaacatgattttccttacccagtcatttttatagttctctcaaacaactaatatttaatgagtgcctactatgtgcagcacagtgtgttgaataattttaatatcttaaatgaggatagatatgagctatgtacagatacctctgatgcaaggtagaacatgccatatgagaacacaaaataaaattgctacaggaatcagaggaaattcacacattgatgtgtggctgacccagttttaccaacactattataatcatgcctctaaagctcatctttaccatggtgatgctgattttgtgactatgttgaccttctagacagatagcccttggggggaaaaaaaacatcttatttatcagacaaacttggactaatcagagtgtaggctgatactagattgtaatgaaaagctgtgagtttcaaagtgtttaagttgtaaatgaacagaagaaagagacatggaggcttaccattaaccagacttgggacctgtgacttacaagtgtgctagagtagttatagttgttaggtatgagcagaaaggaaacattaaggtgaatgtagttaagtattaacattcaaacactagcaatttgttctggaaacagctgataaagttctacccatgggagattaagcttatttgttgaaaatgtaccccttctttcctcaaagtcaaccttaatgctgccccccaccaacagattcaccaaaccagagggactctaccctaatgataagctccataagcagttggtaggtcacgtgagatgtccttctgtatgctgcaaataagtgttgcttttattggttgatgaataaagctgtttgggcctgtggcagagcagaatatagctaggcaggaaatccaagcagaggcacagggagaaagaaggtagaatagagagaagatgccagcagccacagaggaaggaaggtatgtagaaaatgatgtaatgtcatggtcacttggcaatacatagattaatagcattggattaatttatatgtaagaggtagctggtaataagcctgagccatcagtcaaactatctattaagcctcccagtattattttataagcagctgtggtactggcaggcaggccagaaaagctcaggctacaggtagtggttagcttctgctttcttaggaatctgtaggctcaactacacaagtcagtgagctcaaattcactaggcctagtaattggacacttcagagtatctgctgaagacattagaatttgttctattttatgttcagttttgtgttcactgatctgtgccctcccccacttatttttccttctctgtatcttgctgagcttacctggcatatgagactgaaattttcctcctcccacctttgaacaatagtagctcttttccatcctcttgaaatattggtggtcagagccaatgtcttgtatttaatttgattcctcaaacaaacatttctaaaaggccgatgtagcaaacacacaatctggtggaaatgacctggacgctgtgtctggttttccactcactggctctgaaatcatatcactaggacaggatagtgtgcctctgtgagtctcttcagtcccagcaggatagattgctgtggcatgacttgtgagcaagtggcctggtaaggcatcaccgagagatgatcaccacatctaggtattgggtttggaattccattcagaattgctcatatgggcattcagtcgtcagactgaagtggaaatccctttcttttggatgtacacttcaagacacgcccagagagttcagatcagtatgattttccctgactgttccagcttatatccacacaactcttaaagaaacatacgcttagtaaaaatttagcctgctaaaaaatgaactttatgttcaataatttggattatgtatatgggacacagtctcatgtggtagcccagactgtcctggaactcattttgtagttcaggttgtcctggaacccacagcaatcttccttcattaaccacccaagtactggggttataggtataagctgcaggcttcttatcttccttttcattaacttaattttcatacatttcacgtagaatatggttatttatgtgaaagaacactgcagaaaaaaaggaaaaagaacaggatagtaattacaaccaaactttccttacactgacagcagccagctcatttattaagtcaatgtaacacagcagcatcacacttgattgaaatcttggccaagtctgacagatgttctctactcagtgtcaatctcaagtatgttttaatgagttgcaagtggctggagcttccctccacagatgccactgttgcagagattgtgagcagattcttcagggcaatgggtttcgtatttaataagtggtacatggtaagtaacgggtagaaatcattgctggaaatgcaatcactgctctggaaacagccgctttcagccggcagttgatgagcctccttcaaatcagttaaattcacaacagtgccccaaagccagtctgtgtgttgaatgtctgcagtcttaaaagctggtgagagtatctgaaaaccccactctctttggagatctcagaagatgcctgcttcaggacactcactagaaacatgcttaagattggctcagtacattgttgccattgtttctcaatgaaattgccatggagagagagagagagagagagagagagagagagagagagagtacaaagccagtcctacttatttgtatgcatttctagtaagttgcctgtaagattttatatggttatttcttagttttcagatagatagtttgagatttccactggtttatagacttgtttctttttcactttaaaattattacttgtgtagagaaaagccatgaggatgatatttcctttggtcaatctctatctcaaacaaaatggtttatatattttgtatactatgccataaaaatgaatattgcttagctgctgtggtgcattagttttttccttgccaggataaatctatttccagttcctagactatctctttagtttaaatgcaatagtgcacctctgtcctttctctttctttataaatcagtcggaaacctttaatgatccggagtagttatgcagaatgggcccaatttgaacaacagttcttactacattcctctggtcttacaatgcaaaagttgcttaagagcaaagagctttttgtggaaagagatataccttggtataatcagaggaggagtgtcaagtcctagttttactatgcaatatgttgtctgaagtaattgaaacttgcaaacactgtggtgctttgtcagactgatatttataacttctcctgctctgagtttgatttaaaacccaaagcctgtcagaaagccagatggcaagtgaggatatcctcatgtataaatgcttagttgccatgaggtaggaaggaaagcgagtggtggagtcacatgctactgccttgaatgtgtctttgggtaatttgggggaatttcatatgagtttttttaaaaaatatttatttactcttgtctgttaggctgccatactttcatgccctttgagtctccagagcctggctgctgcatgcagcaattagtttgtgccagagagaaaatgagtagtgagagaacgctctgggctgaaatgccatgtgacaaacagtggaatgtttgttagttagaaattagtcatgggttagccccaggtgggcgagtagtgactccagattatttattctcatctttctcagggcagccttgcccttctcttccgcgtggctttctctctggggagttgttaatggcattgccaaaagtatacagcatttaaaaggattaccaacagagagaaatggattgtttgaggcttggaaaggcaatcattgaggtgggcatgttggctgcaaagaggtctttcttctctcccaaagagaagggcaggaaggggcgaggttcctcactgtgggctgattgcagagtgcaaagatggtgggcgactggaggtgtgtaaatagactactctattaatccaggagcgtgtacttgtgtgcgctcctttgagtataaaatcgaaaggtggccgagatcaacggcagtatttaggaactgtttactggagcggcttccctgcatccttggtattcttatgaactgtgggcaggatccatggcccgaagaattcaaactctgaaaatatgcaactgaagctgtaaaaagccactaactgccttcgctgattacatagctggctctgtagactgccaggctctctgcaggcatcgctgcctgtgtctccctatttattttttgactgaaactctaccatggatttttaacctgaaagaaaaaataaacatgcagacatttgtttaagacgactctggaagctctctggtttgctttgaacgccagtgcagtggtttcctctacactgccagctgtaaccacttcagctgcaaagccctttatattcttatttttaaagcagtaattggtaagtgtattttctgcttgtaatcaatagcttttatatttcacgaaatatttctaaacaaaaagaaatattacgtgtaatataaaagctattgattgcagagagctaagtctttaccacatgccattccacatgactgactcacaccgaaattctattatgctaccaacatgacaaatgcttgtgtcgttaattggttctccaatttttgagaaccaagaaaggaaaattttcactctaatctccaagaaatgaaggcttttatatgaaaaataatgtcatgtgatatgaaccaaaactatgcattgagatgtttttctaggtcatgaggtttcatgcaaatttatgtgtgagacccttactcagtaatattctactctgggattttccaagattgagattcatagaacttacccatcataactctattttatatctgtatgtccattatctctatctatagatctaatctatctccctgattacatctatatccatgttctgcatttgtatctatcactatctataccatctgtcttcatactacacccctttgttttataaacacaaacatatgcacattcatatgtacactggtagagatttataaagcctcatctactatgccactcaactcatgtgaagcattcccaatgtagatactgattctagttatttataaggtttctcagttgactccagctaactgtaaaggtgaaagtactttacagtatttatttatgagtttcccttattggccagcccatacaataacatagtggtgttcagtccatggccattttttttttgagctggaatatggtatgcagtccactctgagctcaaggctgcctccaactgaggagataaccattcctttatggtgtgaaggtgtcagctgctacccaaggccttatgggatgcagactaatactgctttacacagcattgattatggactgactgtggccttgctgccactgtggcatatgacttttcctagggcattaggctctagtggtgccataattattttttaaaatatcttggggcaataatgaatgggaaaaagttgattatttttgtacagaataaaataatgcaaagacatgaagcttgtaaaatgtagttaatccagtatgagagagaattgagatattaccagaaatgggaatagtgagacaatttttgaactagagacttaagttgtaatgtttgtcttattttatagatcccatcagaataatatgcctacgatttaagcaaaaataaatcagaagtttactgctttaactacgtgggagtcagagagcttacagtggagatctcgactgcctgcaagagagagagagagatcaaggatacactaactgcattcctgtaaatagctgaacactgatacctcttaaaacctggcctctactcttaatatataagacattgtggaaaatttaagcagataacaccagtcatgtactgtctttagatgtagactctcgaactcaataaaggtccccatcaggtgttaatagtctatgtggtgtaagctggccatcagggtatcttctcatgtgtaggatccttatttcaggacgtaacagaaagagacatcaaaaaatctcccaccaccgagagaaggttcctttagaaaggggctgcagaagagagaagacagatctttgaatttacttggcatgtgaacagaagaattcagctccaaaagagaccacctgctaccctttataggtgctaagaaataccaaaattaaaagtatgagaaataacgatactctaaataaggaagagaaaagaatggtaatgaactttcagaatagacaagtagactgcacggttgctattaaaaatacacatccacaggcagaaaaaaatttgcccaaattttacagggacattttgtagctctaggttaaggcttctaatttacaatgaggctctacagaaatattcattttcttgtgcatgtacctgtggatctgtgggtctgctttccaggtcagacactgcttttgtgcataaccgtgtgtatatatttgggatgggggcatttctttcgtttcattccttttggaaaaccatattataagatttgcttgatacatggaagagcatgttttacacagtattaaattttggaatttactatttgctgggaaagaatcacattttgggtaagaccaggttattcttagtgtattttgtcctttttttctttttggcagaaataacccatagagatctcaaagtaacaattccctcaagtcacagtgtgagtaaataccttattcgcatgagagaggcatctattttcttgaaacatgctctcagccttaagattcactgtaaatcttcactcccagcactcagggatagtacagaggggggctgttgatgttgagtagaagcactgagtagaatatgttgaagtttgattttcaaatgttgcactttaaggcttggcttgcatagtttaagcagacatattcatggatccagacactgacataatatgtacctatatatacatgataaatcataaattctctatcatagtagccataaacatatttgcactagcaaataaaaggacagccaataaggctattaaataatgaactggcaggattcatgacttcatttccttgcataatgtggcccagcatggttactccaaccacagaaaactatagattttagtcttatcccaatcatattacacagggcacatgtattttgtacatttctgaaacccttagtttttaaaacttaacctaataaaaaagatattgtcactgatcaggatatatagaaatcaaagcttttgccagcaattaatttattccaaatcatcatttgtaggtgaaagtatattgggatgatttaaaacaaaaggcagttttgatttggataaatatgtccctcctaatggaatcttgcaagatttttcagtgctgcatcctgattatgatagactggggcatcacatcagaagatgagaccttctgacacattatttgtgctttagatggagattatgcttcttctgttctgccttattgaaaaatggaaccccagataaccagactaagcaattttacatgttacgtactgaagtcttaatgtttcttgtactatgacccccttttaaagctagcaacctgctttgcatctgaatgtagaagttaccttacatattctggtgttagaaataagaattaatggtttttataagctcagtggagagaatattttatcaaaactgttgaaaattcagattaataagagaaaacgatgcagcctgagagaattttataatgtgttttccacgtcattctgcagtctttcatataaaaggtgggatgatagacagcagatggatttatttttttacttagcagcaaaactacaaatcagatataaacaggtaaacatataaacagatctttcagccaaatatagtgtggcagagattctttcagattaatcaagtcaagggaagtgattatgtctgatgccatgggataatataaaagagggatgtaccacatcatctctatagaatagaccagagaatccattcaatataacctttcaaaaggaagtaaaaaacactgttctggatactaaataatttcaatatccatttacatttcagaagaagtcaagtgtatacctttcctatttttaaaactcagaatcatctaaaaggtgattgaaagtaacttctggtttcaggcaatctaaatgtcttcaaagttttacaagtgttggaatattatgtgtatatattggaatattatgtgtatatgttgaaagtcctataggatttaagtatttgggtttctcataagggaagaaatgagataatacacacaaaatgtttaatcaattgtgggttaaaacctcttttatttctctgtaacaatcagaggcagacccaaccaaccacaaagcagtgatggtgagggattctacacattaacaagagggccttcagtggcatttcattctgataaaatggtatttggccaacattctaagatgaaattttcaataaatgctagcaactaacacaattcattatagttactcctggtaaaggatgtgagcaaaaattgccttggctctaaaaaagctttcttgtcattatgagcctagatcaatcatcatcaagtagaagacactcatggagctatttctcgtcagccgttacacactttgttatcaggctccgttgaagacactaagagattgtttttattaggcaggcattattgctaggctctctaagctaagtgtgtttaactgtatttctctgatgaaaagatggaacaatgtgtttgaaggagcccagggtgagatcacctgtgcatccccataaacgccatgccatttagatgtcattttacttgtgtttctgcacagaaagaaataataacatacattttcctattaaatcaagagaaggaagcccagttacttggtgatcactgtgtactggagataaatggagaggttaacgttcacactccattactcccctcagcactttttaacctctctgtgtaaggagggcttaattgctgcctcagatgcatcatcaagaactaaagcttgaaaccatccttaccagcttcaccgtctcacatcttcattgattttgtgtctgcctttatgagaccagacaagggaagaataagataacttttaaaaaattactcatccaagtaaagcttttctgatattaaatgagttttaataactgtcttaccaaaggcaggctgttttttaggcattgttttgcacatttcacacttgtggctctgaatattctataagatattatttcagattcctttggataagttctgtctaaaattttagctgttttcctttctcctaagtcctgtaggagggaaaaaagcttgtagaatcttatgttgttcagggtgtctctcaagcactttagagtctttttgtcagagaaatattcaaaagataaactgtcatctcataggtcatttatggaaagcagacaaaatataatctatatacatggacagagtgtagtacttgttaaagaagagggaattatcacaaatgaaagggagtttgaggaactggagagattgctcggtggttaagaacactactttgaagacaccctatggaaggcctcatcctccctcgggagcagaaagggtattcgatgggtagggcattaggtggcgtggggggggaggtggggagggagaaggacctgggattctgggatagacatgtaaaataattttctttctaataaaaaagtggaaaaaaaagaacactgcttgtttttctgaggacctgggttcaattcctaaaacccacatgatgggtgataactgtctataactctagttccaggggatatgatgccctcttaggttttcatgggcccaagacatgagattgctgtatagacaaacctgtgggcaaaacgaccttccccttaaaaaatcaagaagggaaaggacagggactttgaaaacaattaagctgtaatcaatgactaagaaggacaagtagctgaaaaatccaaaattgaacttgtgactcatctgaaatattcaacatggcagatttgctcttccacatctccactgttatgcaaaaataagtggtagaatttgccttttgttctcaagttgcttaattttcacaaccatggaaacacagaggctatttgttcaactttctacaagatactcgatagaatagtaaattgtcggctagagtataaagctggaaatcttctttgaaagattaattctcagctttaccacagctccacagtactacataaaagacatagcttattggccaagtgcttgcccaagatgtttgaggtcccgggttcaatctccagtcctgtctctcctcccaatctcttataaggaaacatatcttgataaattagttagcttccttatgatattaaccgcaataagattttgtttccatgttagtataaataaataccaattttgttgacctcacagttatcatgaaaaattaattgatgccattaataaacacctctgacatttttatgaatgggtaaagaggaggaataaaataggcaagtgggctcacacatgttttagcatttaaagtaattccatttgatacaacaactgaaacctgaagtaacttaatgactcagtaatttagaggcaaagctaggcaccgtgacacatgccttaaatcccagcacttaagagacagaggcaggagaatcatcaatacaaagccatcttaggctacatagtgagacctgatctcaagaagaaacaaacaaaaattattttctgttccaggacattaagttgattctctctgcacaacaattcacagacctattgaggcaggttatgcaatcatcagctctgaaggatgtacattggcctgttaacaccatactacaagggacaagatgttccatacaatgcactctatactgtggcccagagagaccaaaagactggatacatctagttgagatctgtgatgagctttagttctagtcttactttgatgcctagaccataatcactcatggttgggatccacagtctacatcgatgggaagaaaaaacaatgagcaccttttcatctagaaatgctatactccatccagaagagcatcagaaaactcaatagaactttattcacccatatgctacagaacatcacatagaatggggaatggggttgtaggcttctgagggtgaatcttctggacttggacaagaaaatgggatttgatgtgaattagaagccaattaaaccaagttccactggccaccagccagattcttctcactctcccgctgcattctgtttctttgaaaaattacacataatatcacagactataaataattttgtatttgattcacccagtgtttaggggctgttagcaatagtatttaaacttctgaaaacatttatctatcctatatacaaatacagagtcccttgtcaacactaaagtatttggaaaatcacaagtaaagcatgcaaaactggatctgttctgttcagagatctgtagataccctcttttcaacttgaccttatctcttctaccccaaggttactggccttagcctctagtacacagggtaaaggaaccatttattctctacagccacactttattttttattcatactccacatttcagctgctcctgtgttcccaagctctttggtctttgggggtcagtctactgtgtaatcaccttcacctatggtttgctgaaacagtatttccagaggctcagacagaatccactttttctaatcagttcatttccaatttgttgaatctgataaattctccattggcctttttcatttataatcttttccatttccatttctgttccctgttaatccaaatgggtaatacaacatccacgccatcatttcaccttcaaattaacagaagacattcatgtgaatagacttttatgaaggtatgggctgttctggaaggaggtttcatgttttatcagggcacagtggagaggcagtttattgttaaccatccctgttttcaaatgagggcagactacctctaccagcgactttcagccagctgttcttcctcttcaaatttctacaattttgctggtgtattctccccattcttcttatcccctccccttccccagcttccaagaccactgttagcatttctccaaaaggcttccagtggaaacttgagtatattcttatgttaaggagttttaagtaactcatagtatgttctgaccatacaaaggaagctatttatatagcctttcaaggctgcatactgacctacactgttctttacctaaggaatgtttttaccaattttaatgaaaaactctcctctcttnnnnnnnnnnnnnnnnnnnnnnnnnnnnnnnnnnnnnnnnnncatcttttcctttctgcctatcacccttctcttaacctgaggcttaaagaagatgcttgtagctatggcctctctgttcctggaactcaatattacaggcatttttcttggaatgagcacacagtgctatttgtatatgcacagaaacactacaatgacggtaagacaatggtgatcatagctgcaacatatagagacaacatttatgtattagtataagctcacaccttcttcaatatcccaccagcacactgtgttgtctctaatgtttctgcattattgtgcttggtgagtagaagcataacgatactctaaataaggaagagaaaagaatggtaatgaactttcagaatagacaagtagactgcacggttgctattaaaaatacacatccacaggcagaaaaaaatttgccccacttatgattttttatgatggcactgctttcacattgcttaccctgttattgctctctgggtgctccatctgatttccataatgtatgttcatagtgctcctgtttattgcaacagattgctaagttaacttatcatggcttttctgcatttatattttctcccaatttaaagtttttaagagacaccaaggcaattttgacagttacctaataaagctgaaattctgtctacaacatgagtaccctgggtccctgactgcctttggctctataaaagcatggtatatactagttttgcattgatcagagtgagtctgcctgcagtgagccctgggcatgctctgggctgtgaagcttaaggggagcgagggacggtgtaatcattgtgagagcagcttagatcgatgctcacggcaccagcgatgaacccttctctagaggggtgtattgcagctgtgaagtcaagcaaggataagtgtgatggggtggaacttcaatttttctcccagtaaagaaactcgtccagcagtcacagctgatggatgatgagcacctcccttccttgggatgtctggtgagatgagctaatattcaataaactgaactgtgaagcacataaacgtttcctttaattacaagtgtacacctctgccttgggccactatggaaagagatcagtccggctaccatcaaattttgggagcaagttcactcagaactctcatgaaagtgaaagcttggtggtctgatgggcttgggataaaagaaatatgacctattcaggtgatgcctcaatgagtagaaacctacctcttggtgacagtggcatttcgtttgtttgggaaatgtatttggctggtatttctctttctgttagttgcagaacttagtctgagtttgaatgttggcaactattctgaagttgctgttttcttcagaagtcttttgaatatttgaacatagtttttgtctctctgtgtatacgtgtgtgtgtgtgtgtgtgtgtgtgtgtgtgtgtgtgtgtgtgtgtttgtactaccacaaatgtgagactggaggaggatattggataacctgctctattagtcttttccttattctttgagtcagggtctattagtgattttggaatgaagctagcaaaagcatcaggattcttcctgcctctgtgctgacaccctccgccctccccccgactcccactctagttctaggactatggatatccacagtggtgcccatcttatttctctttctctctctcttctctctgtaagtgggcctgcttggggatttgaacccagatcctcatgctttcacatcaagtactcttactcacagatctacttaactattcctgaacatggtttgtgttttccttctatgctttcactttggccattctaactgcaaattctaactttcctcaaatgacatatcttgtttctgttgctatcatatgaccaagtagaacataacagtatcttttaaaaatgcaggtaccaggacaaacttcagtaatctagatttggataggtaaattctgtgttaggaaaaacttagccttttttgatactgatatttatctataacctaagacatgatagttgttttatcagcgacatagacaatgtgattgtctggtgagggtccttttaaaaagtaagacctgatcttatagctggtgtctctcattcttaaagcatattgttgattttagaatgactattcatttgccatattattcccatctacttatacattgttagagctactattattttttgaagatataaatgattttttattcaaattctttaattattactcatatttacatatccatcctccccattccctcgccctcctatcctcccatgttccccaccaatcccccaacccattcctcaactcctccccagggatagtgaggccctctaccagggactttcaaagtctgtcatatcgtttgggggagggcccaggccctccttgctgtaactgggctacaatagtatgtatccctccatagggaatgggctcccaaagtccatttgtgctctagggataaagactggctccactgttagaggtcccatagactgtcttggcctcctagctgacacccacattcagagggcttggtttggtccaatgctgtttccccagttttatgactagggtctccattagagagaccttaaccaacacaaatgcttaaaatttactgttaataaatggatatgttttatgttagactaatttatatatttaaaagacagtctatctatttaccaaaattccttctgttactttgttaattcactgattaaaaatcagaatcagaatcagaatgaaacaatttgaagaatgcctgcagttagcatcctgcctgtggctgatgacacatcatctcactgttttgttaatccctcgaagtccactctcatccactcttcatatcccctatgaatcatgggaaatgtgttaaatttactgctgaatttcatatgtactttgcttagattattcatctttgccaatgtgtggattctattgtaaaagatgtatcattggcatcatctgtcgtctgtggagtcattataggtgctagcaattactgttctatctgaatgtaggccacaatgaatccattaaaattattctcaaattatgcaatagatgaatataaaattatcagaacatttggaggaggcagggacacaggcacttatcatcaaggaccatgaatacttggatataattaaagggctcaatactaattctacttgctaggacagtattaatgtctatcttctttcaatatgatcggttgtggaagaacctgaccttgttgaacttgctgagaaggtcatttctgagggcaagtataacaaaaggctgagtaggagatggagcgaaggttgggaaggcacaaaatactatgatttccagacttgtgttactcatgaaaatgggtcacagtttttaatatttttgatttttctgactcttttctccttatctagacattgctactagccatcctgctattaaacttccatatcctgctaaatacccttcagtgtcttcgtttgtgcgtggtgacataaaggtaattttgaaaaagctgggattcctttgtcatttctttacttactttgcactagggtatcatcatcagcttttgcatcatttcaacatgagtatcactttccttaataaagaaatggaagcaaagtagaagtaaagctgctttcttgcccctgtctctgcttctcactgtaggatgcacttcagactcttcctgtgccttcttctttaccaaagttcttcactgaagcaaaggtttatcctgctttgtgtctgtccaatgcagaactaagtgctccattcgtagcattctcgctagtcctcaaagctacataattgctcaatattgctacctgcatttggcaaatgtagaaaatttaagccagggacatttggtattttttttttttatgaagcagcaaattcagactaagaatctgctctgtctttgttaaaattctcttctaagaaagtttttctgtgatgttatttctgaaaatttagtactgtattccaaagccttggtataattttgttttctccaatcctaattctcttctccttccactggaatagtgaccctgagtttatctggtttggttttacctctccttcctcctttcaaacatgccttcaaaaatttcaagttgattgtgttgatctagtgacagctttcccccttccatgcatcattcctaggcactttatattcagtatggtttttgaaataatttaccccatgttagctacatttctatactttatgaattgacaacatttgtgaatgggtttagggcatcaaagcatgccaagtgtcagatggaacagactctcttcagcccttctcacaggtcactcttgggtctctgaacaaggtggaaatgaaagtatgggaaactgcctggtagtggtggagcacacctttaatcccagtactcaggaggcaaagtcaggtagatctctgcgttcgaggtcagcctgatctatagtgtgagttccaggacaggttccaaggctacagggctacacagagaaactctgtctcaaaaaataaaaagaaagaaaaaaaaaagtatgggaagctgtacacacaggcctcttacccagtgccctttagatcgcaaaccacactcactgttagatgcagcatgagaaacagatggatgctgcccttcaggatcagctccttcagtgtgtaggttgagctagcctccatagagggaggctgcttaagtgaaacgatgattatctgactggtcctcatctgtggctttatcacagaggacagaaaggtcaggggtaggtgagatatatttacttgtggatcagcattgcagattattacctgttattttcagatttacatgataactttgcataggcagaattcaggtttcttgggaatctaacaccaaatattatgaactgaaaaaaattgtatttcctttttaagggtgtcataacacttaaaattatgtttttatttatgtattagtttactaatggaagaatataattttatagttataatctaatatatgtatatttagagattttgacatttgttaaaatatcaaccattagacaaaaatacatacttttccaatttttccagcatcatttgaataaccactttttggaaactttacataactagaagtagcctttacaaaccctgaaatgggtagaattttggtttttctattgagtatgatgttaagtctgtgtttatgccctatcttgacatatgattgaagctatggaggcaggcctgacttgacactcctgcataggcaggcatgtcccacctgattctaaaccttccatcaggaatagttacgctacctgcttcaaaccattgtggtgaggaacacataaaacatctttacagatggtaagactataaagatgtttgttatctaacatttggctttggcccatgtgccctcttggttgccactctggtctctctccagctcacatccaatgtctgcaaatcccctgctctgatggaattcagccgagagagtcatcttcacactcaggtatagcaaggcagctgctaaggagcttcacattggaaatgtgcaactcctatgtaaatcagtgcatcttgttcattaacacagcttggggataatcaggccacagagccaagagcatgttggaagaagtccagacggctccaagcccagctagatggagacagattgggatatgtctggaaaccagcgtctgcctgctaaatactacctggtattcctgcaatcactgattagcaaagaagtaaacgtatctcaagcactgcaaccccagctgaatctagacagatgaagaccccacatgctttatacagctctcaggagcatttttcaataaccagagctgtgtgcgattcatttgctctcacctctgttctcctgaatgacactgcttggcaggaggttttgccactttcagaaggttcagggcctgagtgggttgcaggctgcctcagtggagatttatcttgtagaataattcattgagccatatgttccaatgaatatatacagaacattgtaaatacatccatggaatttctcatttgctaccggagggaatgcatctctcctgctctccaacagagcatttgactgcagatgttagaaaatattttgctttaagttttgttctgactgttccctctggtatgatttacctggattttattttctgctaaagtctgagctgtgggtgggtatttcatttagaaatgccaggagcacccttgggtattcttggtctgattattttcctcagaataatctctcctggcatttgcctagcgtagcagagtgaggatgcatcacatgccacctgtttaggcaccggctcccatgtgatgcagaaaagcattgaattacatctctgaatcccagcagcatagcaagaggctgtcctaattgaggtctttgataaagatctggttttgttcccacagtctgagccctgttgtcctcctgtctgcaccttccatggaatgcatatgactattgtctgtgacattaatatcatcactttagctatgtgctacccactgtaagctgaaattatccagtgtttaaacttttatgagcatccaggtgagtccagcagaagttaacaggggcatggacattataaattagtttgtctttgatagaatgcctagtgtgggggcaaatacaccaaaacgtcagatcaatcagtcagttgttgctgtattctaatgccatccagcatcatttatgaagagtactctgttctctattcaggatagaacaagataaacagaaaaggatgagagaatagaacaagaagacaagaaattgatgaatattgaggagaaaattatgtaatctcatcatttttattcttattgggaatctctgagatctcttaaaatgtggtgaacgtctgcaaatggcaagagccactgttgctgtggagatctttggatttctattctaagaaaataacaaaaagtaatagaagtggtgtatgaattggttgtggttggaataatgatggatgtttaaatgagaaactttatctccacctatatttgaatattcatatttaatctctacctataatcatataataaaacttcaaacatagacttagggacaaaatttctctcaagtaggcattggtgttaatttttcagtgtagattataaagcacacatttaagcattttcactctccttgcttccctcaaatgctaataaacatttcctttggtgtctgtgtctcctatagtggtctgttaataatccagggggaaaagctcaacattggctgactctggttgtataaaagaagccagtgactgcagacacagctgctaccaaaacaaaatacaggttgttgtagtctgatagctgttggctctgtgagtgtttaagtatctgggtccagagtgttctgcagtaactgtgtagtagtactggaaacactccaactttaagatgccacagttgtgacagtcatgatggcctgtgccttctcctatcaagtgttattttatcttatcaagttcctgttctttctgaaagcaggaaagaatgtgccttccagaaaaaatcaagttcaaaatggtgcctgtcctctgccatgattgttcataaagttaagtttcaattaacaacacaagattagaaactgggaccccattttgtcatcctcctgtagctatctaaaccgatatttaatgtgttctcaactccatcttgaagtttcccataataaaaatcaagtcaaagccacagtcaaggttgtttttaacttagaatcccataaatctttagtaaagcaatattagattgttaaataagaaaagcaacttacttatttgtgttttgctttagtttttagagacagcatcttgtcatattatctctaactagctggataaactctgtctccgtgttttctcttgaactcttgaactctcttcctgtttctgctttctaaatctgggatattgctattgtgtccacatatgagcatctggaattgtatccagatgcctgacaagaaaggacatttattcagtgcacagtttggggggctcaaagtccagcaggtgtagtacaggttaagggtaaatcccgttgctgtatcagctcatgatgctggttcgtgattggtgtttgcaaaggagtgtcactgggggccagaaagtgatggcgtctcaaacctgggtcacaaaaaggagggagaagatatttgttccctgtactcttcaagggtgtatccccaatgagctttactccacagtagatgctacattctaaacagccacagtacattccattgctatcacccttacctagtaatctttgtgatgtacttgaattatacccaaaaccgctttagtattgtgatacacaattaggacttgatagatagtatctacaacttgccaatactaaaacaaagtgattagaaattactgaatctggtttactgcccttttatcataagctggtaaattaatgcttctgttagacgttgctcaaatacatgctttgtcctgattctgcatcatccttagctttcttgttttatccaaagctaaaacggatcaagtctttgcatattatgctggtatctttcttgaataacagggtgcttcactaactgagaataatttttagtttatttgcatgcagttggttaacgctcagcctgtacgatgcagcaactttcctgcagtagctgtttctgtgtctatttgttgccacacataattgcacaatgctggagcgacagttcattatgtgctcttcaaaatacatgtaaatgcccccagaaaagagtgcatctgtggtgggaggaatttttctgcagcctcccttattttagaagaaattaagagtaacttttgataggttcctacctgtgagactttacttttcacccaggaaacttgtgcctttggttgttaccataatctacaccatgacacttttatgtatagtactttgttgtgtcttcagagttttggtgcataacttacttcatccttgttgcataaactttattcaagcgttgctgtggaatccaagaactagttctttaagaattaaaaaccaaagagcttggagacttataaagaaaattgtaagtctgtgaattacttctaataaaaatgtgagtgtggaatataactgttaaattatgattagtgtgtcctagtcctagctgaactatgtgcttgacagataaagaaaatataaaaggttggctgctggagacttgtatcacacagaccttgattttgaacttcatcgagtaacttggggaactcatttggtgggttgtaagtggtgggtgaatctgagcaagagaaggttgctaatgaattaatgctatgcataaaatagcagaggtgtaatgagctagtgtagtgtgtaaaatagtggagacaggagagagtaggggatggagacaggaggaatgtgggaggagtggctgctcatctgagcctttcatggctttgatagttattctcagggtattctgcatggggttaggtcttcttgtttgtccagtgcctcagtaagtcatgggtcagtaagtcttcacacatggaacatagccccaactaggctggatttaatgactttatcgatttaaaaatgaaatcatgccagcaatttcattggtatttaaaaattcaagcctgattgttttatactgcatgtggtataaaaattaagatgattctgtttgaattattgctaagacaggtttattttgttttatataaatcatgtggctttagacaaacttctcaaatatttgtcaaacataatcatatagaactgggctatatttaactgttacacttgatgaattaaaaatactttttagtttgtcaattaagagaaaaattgaaaattgaacaaaagatgaagtgtatgataactgtgatatatttattgtgtctgataatttaattctccataattgttgaaaacatgagataggtttttaaaaatagcctttcaggtacttagaaatcagtgtttacttaaaacataatttatatagcatgtttggtgacaaggcattgttgagcttgatttatggggatggatctaacaatgtgtgctttttacttcaagagaggtaggcattttttatgtttttaaataactgactttgcaaagctactattatagaactataattccatttaaacttttccagccaaatgactggcagtaaatacaaaccagacatgaatttctgtatttagccactgaactaaaccaagacaggaggcatcataacacagtgaaaacaaaacaggaaaacaaatgaagaggaaaaccttccttatcctgagtctttatttgtgtcctttttgaaacttaaaaaagaaccccaaagccttttgaagttagtgctttgtctcactattctctttaaacaagtgcctttgagataaacatttgtgctgagaatcaaaaccaagcgcaacattgataatgtggtaccttatgtaggcactgtgtctctacagtccgtgtgtctgttgggtgtctgctcttgtctcttgtcatatgctcagtaacctgcttacacttaggtggcagtcctacattaaccacctcagagaagttctgtttcctataggcaggaagacctggtaattgtgtatgtaacaatctcctcaaaggctccaaactggagtttcatactgtagtactttcttttctggtgctgtgctaaaaatactctaacaaaagcaatttaagggagaaaggttttattgtgaatcacagttcaaggtacagtccatcatggtggtgaaatcaaagtgtcaagggcttgaggcatctcatcacaacacatcagaaccagaagtggagagtgatccacgattgtactctacttctcagctcccttcctccacctactcaggcaggatcccaactaggggatggcacctcccatggtgggcaggtttttccaccccagttaatgtaatcaatacatatccccaaggcatggccacaggactgttttctgggagatttttgttttattaagttaaccattaatactgaccatcacatactatgtggatagagaatttttgagaaattggtgccagtgttagtgataatttccctctggtgtgagttgatttgacttgtgtccttatgtgcttcttcttagcttgctcgtttaaaccactatgaaagtagaaagctagaagctctaaaaaagatttgttctccacacgagtaaatcagtgattgtacacaaaggttatcaagggctttgtgtatagtctcttgtaaggaaagcccaattttaagcaggattattggtcagttagctcatcatatatggggaatagctgaccttctatttttctatgatgatatctttgactagaagcttttaaaatacaatacaaagatagtaaggatagtgtaattagcctggattttgattaatgccattttagttttttctaaagtttttgtgtgtacctttctttagtttctctctttctcccccctgtataggtatgcaagccttattttagttttttgtttcatttttttaaaactgactatttgtcattttatcctcatctataaaacataataatgctttaaaatttcaatgcatttcattcatccatcactataaaggacagtatatacttagtgcttcagaaatcatcaagattcattatacacaatatagatttttatgttttataaatttgaaaatcattccaagtcttaaaaacttaaagtataaaaatgacccaaacctgtcctttccaagttactctgttagtatggctctcattaatggaggtttatttgggatatcttttatttttgtctgtgatggtcttgggtaatctgacatattaaccatttacaatgttttaacagtccagaagggcttaatcccttgggaggtaacaattgtggagatttaagttggcaaggtaactgctagaagccaaagtagtctattgggggtggtggtggtggtggtaaggaagaaaggagtgttgaaagacatgagacaaaggaacaagagcaaactaggagcatagggaggggagggagttaggaaacagagaatgggagaagaggagtggggaggagaacatgagggatcagtaagactgagtccaaggaagaacagaggagagcaagaaaagagataccttaatagagggagccattataggtttaaagagaaatctggcactaggaaaatgtccagagatccacaaggatgatgatgatcccaactaagaatctaagcaatagtggagaggctaccttaaatgcccttccccccttcatcaagtagctgatggaagtagaagcagacacccacagttaagcactgagccatactcctggaattccaattgtagaaaaggaggagggatgagcaaaggggtcaagactgtgcttgagaaaatcacagaaacagctgatctgatcaagtgagagcacagtctaaagctggggaaccagcataggacccaaccaagcctcctgaatgtgggtgccagataggaggcctgagaagtctatgggacctctggcagtggaaccagtatttatccctagtgcacaaatggactttgggaggccattccccatgaagggatactctctcaggccagatacatggataaggacgtaggcccttccctaaatgatgtgacagactttgatgatcccctatggaatgcctcatactccctgggtagtggatggcaggtgaaaaggggaggtaagtggaaggcatgggaggatgggagagaaagggaactgggattgatatgtaaaataagattgtttctacattaaataaataaatttaaaaaataaactgtggaggtactcacttcataataatgctccatacaacaggggcctatatattcactatggacaaagagttattttttatgactataacctattgatcaaaaagtgtagctactaagaatgtgaaatacattttagtgggtatgcaacaaaaataaaagattatgtaattataaatttagtgaatacaatacttaggctctacctactgtgtctactgattgcatttaagcataccacagagaaatatgtgtaacatttaaaaatgtttctatttatattttctgtgtgtatattttagtgtgcatatgtgtatgagagtttacttgtgcctgaggaccataaaaggtgttcagatgtcttagagctggagttataggcagttgtgagctgtctgatactttctgggaactgaacctgaatcctctgcatgggtagaaggatctttttgctactgagacatctctccagcccatgtgtaatatcagtaaagataattctgcatatattattaatgatgaaatattactcacttcatatacttgttctggaaactaaaggaataagttagcatatacagactcatgagattgaaccaatttttgggtacggaacttgcattcaataaatatatattattgtcattgtcattgttataactgcatttgccactttaagatttttccactttttaaaaatttatttattagttccagttagggaacaatcttgtttcacatgtaagtcccttctccctctcctttccatcacccccatccctcctcccccatcccaagcccaccccccactccatccacccaccactccccaggcagggtagggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctagccagaacttcaagtacaatattgaagagatatggagagagtggatagccttgtcttgttcctgattttagaggaagcgctttgagcttctctccatttagtttgttcatcaacctggtacagaccccttcgctcttcattcctccctctcttcaattattcggtgctgtcctgggcccttccccatgtgtccagggcagagtgtaacccttcacatgggatgggctcgaaaagtccgttgttgcaccaggaaaaaatactaatccactaccagaggctccctggagtgcagaggcttccttattgacatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtaagggcagagactcactcacctagttcctgggtccatcgtcctgtcggtggaatggaagagtggggtggtaccagattcagggagcagggcactcctccctgcctgggcgtgtctacccaagtgggcacaggcagggggggagtggttggggtgagtgatgttttgggtgggagttgggtaagggcagagactcactcacctagttcctgggtccatcgtcctgtcggtggaatggaagagtggggtggtaccagattcagggagcagggcactcctccctgcctgggcgtgtctacccaagtgggcacaggcagggggggagtggttggggtgagtgatgttttgggtgggagttgggtaagggcagagactcactcacctagttcctgggtccatcgtcctgtcggtggaatggaagagtggggtggtaccagattcagggagcagggcactcctccctgcctgggcgtgtctacccaagtgggcacaggcagggggggagtggttggggtgagtgatgttttgggtgggagttgggtaagggcagagactcactcacctagttcctgggtccatcgtcctgtcggtggaatggaagagtggggtggtaccagattcagggagcagggcactcctccctgcctgggcgtgtctacccaagtgggcacaggcagggggggagtggttggggtgagtgatgttttgggtgggagttgggtaagggcagagactcactcacctagttcctgggtccatcgtcctgtcggtggaatggaagagtggggtggtaccagattcagggagcagggcactcctccctgcctgggcgtgtctacccaagtgggcacaggcagggggggagtggttggggtgagtgatggtttgggcgggagttgggtaagggcagagactcactcacctagttcctgggtccatcgtcctgtcggtggaatggaagagtggggtggtaccagattcagggagcagggcactcctccctgcctgggcgtgtctacccaagtgggcacaggcagggggggagtggttggggtgagtgatgttttgggtgggagttgggtaagggcagagactcactcacctagtttctgggtcagtcggcagaatcgatttttccactttttatttcattagtaaaacacatagataactgtgggagttttgaaatttgtgtttgtgtttatgtgtgtgcatgtgttgtgtacaagtaagtgtgcttagaataatattaatagagcccaaatcagtatggccattctattgacccaagcatgaaataagatttttatttgcaggacatagagattctgttttttcaaaatgttttctttaattagaatattgtataccaaagtcatgatgaattctctttgtactttctaacttgttgagataattagttcttaattacatataaagcttttataacaaataggttacttttctaggagcagcatttatactatgctgctcctgaaaaagtaacgaaattgtgttgttggggaagatgttctcttgaataagatgaagaacctacttgcctttttgaatgtgacttcactgtattttctactttaggggagttgcttttgtttaccactgcctaaatttctcaaaggcagatggattttcagccctgcttgtcagtcagtaccatttggcagcttttcatcgacacaagaacctagtacaatggaaatgtcaatcaatgcacatctttgatcaaaagacttcccttgcacatcaagtaagagtgaatgtggccttttgacttatgtacaaatggcttgtaagcattactttgggttttgtaaacgaatagccttgcatcatagttcattcaggcagggaaaaattctgaagtggatttaggagaagccctgtgagacatcacaaaatatagtcacatgctaaaggtggctctatggaacatattgtactgctcatacactgactcctataggtccttgaccacacaaggccaaataataaattcctattagctaaaagaaaagcagttctgcttatttctttatttttgatgcatcagttaaagaaaacttgcaagaaagaaacaaaattgtcagcggacttttctgataatggcattcatgtaacaaacttcagtagtgacaggagttcacacaacttgactgcacagtggtaactgcaatgcccacttctgtccagtcacctttagcaagtttgctgagtggtcctccatgtcagccttttctcatatacctcataggacctcacacactgtggatacaaggtatccacagtgaaacagaatgtgaagacaaatctcaacatgattgaatccatattttgacagggatgtgactcaggaccaaaataatccaggctatttgcctgcacagagtcaaatggacccctgatcaacatgttaagtggcttgaatttgaccactgtcagactggaaaccctacagaagaacaaagaagcaaaggtcagcttagaatgccattcttaatatgtccaaaatgagtgatataaaatacaattccattactatacacaccttcagacataaaaggaaaacagcaagaagaaatcactctgaatttgatgagaattttttctaaattcatgataagagttttgaggtttatccaagtcataaaaagtctgtcacttttattatttactgcatcaataattactttcaggatattttaattcaaattttataattctttcttctaaatataattctttcttctaaatctttttgaggtttacaactttatttgtaaataaatatttacatattatttacatattattacatattacaataatatgtaaataaatatttacatattattacataaatacataaataagtatttatttcaactaaaagggcccaacactgcatcaattaatagtctaatagtatctatctatctatctatctatctatctatctatctatctatctacatgtctctccttatatctttctctttcctttgtctcactttctgtctgtctgtttctctgtgtgtgtttgtgttcatgcatgtgaaggtcaacactggatgtcttcatctctttccactttatatttttgacaaggtctttcaatgatttggatagactggttggccagagaaccctggggaatccttgactctgatccccaaaatgttaggattacatacttaggctcgtcaaactttttatttatttatttatttatttatttatttatttatttatctaattcttctattatatattatattacaacaacctttcccctccctccactcctccaagtctcccaaccgtacatccacttctcctccatttcccttcagaaaagatcaggctttctggagatatcaaccacacatgacataacaagttacaataaatctgggcataagccctcatatcaaggttggatgaggtatcctagtaggacagaaagggtatcaagagcagacaaaagtgtcagagacaccccactctcgtgttaggagtctcacaagaacatcaagctacacagtagaacatttgtagagcacctagcacggacccacacaggctctgtgattgctgcttcagtctccatgagcccctataagtttggcttagttgattctgtgagccatattctcctggtgtccttgactcctctggttcctgcagtccttccttcccctcttctgctgtttttttccaatatccaccaaatattttactgtgggtctctgtatttgctcccatcagctgccagaggaagcctctctgatgaatgagctaggcaccaatctaagagtatagtataatatcattaggaatcattttattgacatttttggcagtcatgtttggttctaccctaggtctctaggatatttagcttccagttcctggccatccagccagtgtcagacatgagcttcttctcataacatggacctcaacttagaccagtcactggttggacacttgcacaagcactagcccattgccccagtgcatctcataggcaggaaaagcatggattgaaggctttatggttgggttgatgttctggttccaccactgggagtcttgtgaggtcaccaaagatggcacattcaggttctatatcctccttaacttgttcttgctaggttcacccttagtgcagtggaaactttcataccaaagtttttaatgtgggttctgggaagccacctcagttccctgtgatgccttgttcatgaaatcatcaccccagtccaatcagttatttttatttaaaatattatattattgggttgaatatatccactttgacaaattaaaattgagtttgttagtctgggatccatcaatatgacttaatttggaattactccccttctgtttttttttttttttctttctctgtgtgtggttttttgtttttgtgtgcttttatttggttacagtttggtggttttttgttttctttttgggtgtgattttttttttcttggttggggggttgttgtgtttttttatttaaattcttcaatactactcataattacatatctatctgcccattacctcaccatcttctcctccaatgttccccatgaaccccccaacccattccccaactcccttcccctgtaatgagattaatgtctaccttggttaccattcctagcgccttcatctagtagctgttcaaagtagaaacaggcacccacagctaagcactgaaccatatactcaaggaatccagttgtggagagggaggagggatgagcaaaggagccaaaacagtgctggagaaacccacagaaatagttgacctggcttattgacagaatgaagacactagtcataaagctggggaaacagcattggactgaaccaagccctcagaatgtaggtgccagctaggaggccaagacagtctttgggacctctaacagtggagacagtctttatccctagagcacaaatggactttgggagcccattccctatggagggatactattgcagcccagatacagctaggagggcctaggccctcccccaaatgatatgacagactttgaaggtcccctgtggagagcttcactatccccttgtggttttaattgagttaagatgaggtctaccatattagagttggtcctaattccatcataattgacacctttgtaagagagttttagatgcagaggcacacacacagactgacattggagaaagaacaggttggaactgtcattatgtatttacaatactaggaatgctaagaactgtatgcactgctgaaaatgggatgagaccgtgttgcaatgtctttctactctgtccaaagagacccctacccctactgatacttgacttgtagattctagtccccagaagcctgagagatgtaattcttgttctaatttacccagttgtggtacttttcttggagcctgatgtaactattatataattagaatttctacgctgtgagggtggtttctgcctttttttttcactgtatggacccatgttgagtggttctgaatttaaatttaatttacagtgagattttgaatgctgacaggttctgatgggttcttttactcgattccctggtaatccctgccctgaaagtgcgaagagaaaccgatgatgctttacatagactgttatagaagtgaaaagtaactacctctcattccagagattgaaaaggaacatgaacctcacaagcttggactctgactttggagtgaagagacactctggacactgacacacatcctattcttacctcagtgaataacctctatttctctctatatgggtaaaatataggtgctgctgtgttagtgcctgagaccaaagagccaatgttttttttttttttatgtcaccagttcatgtaacaagtatgaataaggagtagaatatggaattttctttatttaaaaattctttggtatattttattagcatatctgcactgtacacaaggtcgctcaaagtcattttcacacaaacacacaacatattttgatcatatcccccatccttgtcctccatccgttcttgacctcatcccattgttgctgacttccttacccatcttaaccaacccctttctactttcatgccgatattttcacatcctagtggggttttggttgctccaggaatgagtaagaggatcatttacagaagtatgggtacctttccagtggtgacagctctgaaacaaacatctcttcatatcctaacaaccatgagctgcatgtaattcatcagggagatgagaggcctcatgttcctccccagtctttggcaagatgctggtagggccaatcttttgcagatcctgtgcatattatagtcatttgtactttgagtggagtgccacgctacatcacacaaagaggacaccatttcacaccaactcccttttcctctggctctaaagggttttccatcccttcttctgagctgttcccctgatctgtgtgtgggcagggaggttagggggattggatattccctttatggttgaacattcaagtgtcacttgaatttttagtaattaaacacagaaaaatcctattttcctctttatgaatttttgtttttgaaagtatatgccctgaaaaatacatatacttaccacaaataccttagcacaaataatggtttctaattgttatgcctatacccagaacacatctatattataaacactgactttacatttgaggacatagtctatagcatagctgttcttgtactttatctccagagaacaggacttgatgaactttgtaacagttttgacagtgtacatatttctctcataattataaaccatttatttttgtattaataaattatttgtaacaagtaatacattaaaagaaagatatcacctttctcttcctattacatgtaggtcttcagcatttatgctcctccaaatttaagttcgtggaagatgaaacaatactgctttgtcttcttttagtagacacagcagccaaagttcttatccagcactattacacaatgacatcctttccattaaataaccaaatggatatatactatgtttatttcccttctgtccttaaaaatattttttacccatcaatcttatgtctgaaaaatttcacatgggatattgccatccaaagactcatggtcaagactttacttatttcatcaattccaccatcatcatttcagtctagaatgtcactgtttgtcactttgcattcatcttcagattcatccaataattgtgagtcactgtcctttgtcaattttcttctttttgacagtagggaatgaaaataagatttctgcattcttaactgtgttcagtagaagctaaaagtattctgaaaaaattttccctatgatctcctttgatatattttttgagttaatgatataatactttggctaactcagaatgaagacagaagtatggtacaataatgatgacttatttcacagatgaatcatcattttaggggactctataatttttctgtttccctattactcattcatgtctagcattagtagaaataatcagtgacaattaaaacattttttccagaataatgaaatggcaaattgtttcaatataaaattattttagattcaccatgcaattcggtgatggagtgtgttttattgcatataaaaggataaacaaaatttatctttgttctttgtgagaatattaacaattaaacttggaatgtggagcagcaatctttaaaaataccagcaaagaaacccagaaactaaaattaagtgtgttagatgttacttaatagaccaaactgagtagacataatggctcacaagacccatttcattgggtggtagaaaaatggttaaacatattttcattagaaacatggacttattccatttaaaaaatgtctgtaatcctttcttatcccatcatgcacttcttaggtacactgagcaccatgagttctttggatttatcctctactgctgtatgaactctgtcagagcagcagctttatcatcatgggtttctgctagtttgcccaaatgttcactgtagacctggttcatagaggttctctaggaagtccaatcattgcataaaaggaagaacatcagaagctactttgtccacccacctgaacaagagttcagaggatcactgcatgcctggcatctttgagaaaaggagcttcgttttttacttctcaagacaacctttgattttagagcacttaggctcttatcaagtcaggagatacatccctggagttcttgagacaaactcccaggttaactccagaggctgccattctagtaagactttggatgagttatccagtatagcttctccaggtctcaggctagccaactttaaattatggggaaaaaaaagccattagtgactttttgtggatgtactgtcatgattaagtgatgttatatgccacgaatcacagtgtctgatacacactaggcctagttaataatttgctatttttaagccaccaggatgattattagcagattgaccagaaatcttactatctagtactttagtcacttttagtaattctcattttgagtccctacaagccaataattcccacataattgtcagagtctaagatggatgatacttctccttctcaaattgagtgtcttcactgtttctgtgttctcataatattgtttcttctcggtatttctctctgtgaccatgttctcatggtgtcctcgacccctttggatcctacaatcttttctttccttcttccccaggattccctgagttccacctaatgtttggctatgggtctctgcatctgctcccacaagttgttggatgaagtctctctgtttggtgataattggacaaggctcctaatactttcttactgctgttctttactatgtaagtatcaaattatttcaccctagatttcattgttttaacaagttcatttatctcattagtatacaaatcttctttcatatatagtaaatggtaagattatatgtgtgttacagaatggttttcaaataaatttattcgttatcagcagtgtttgatttacataccaattttataaaccactatatgtggtgttgtctaaaaattttgggttgaaaaatgatattctgtaaaaagttccagaaacctgactctattatgaaaaagaagtgtttgtgttcaacataaggaaatggtacaagatcagatatactaatcaatttatgttgtcattcctcaatatgtgcaagtattataacttcacattatgctccacaaatatgtacaatatgtacatatatgtacaaatatgtaggattatgttaatcctaatttttttgaataaatgaaatatgaatgattttgtcaaagatcatgcatatagtactagcttataaagtattgtgtagatgcaatgctcaagccatttttaaaactttgaatcacctcttaaaatatagaaaaagcaactattgggtagaaatgaccatatttctatgctaaaaatgaagaaagtggaattaaaaagggtcaaaaattttacaagttaacacagctgagcaggtggtactgcctgattgaacctgctttcttatctggtggtcagcctgtttctctgcaaagtgactgtagtccataggtgagatttggtctaactggagtgacacaatttctggttaactcagtctctgccttccatctcagggcacgagtgctgggattatgaagagccaacatattaggctctttgcatatgttcccaggcacctggtgaatatgttaatttctagttcaatttccccatctgctcctaagaatttttttttttgtaaaacatagttaaatatgttttaaaagctgcatgctctctgtcataaggatttctttgaatttgagaatggcaacatgtctgaattgggaaacaatgtaaaattaaccaagcctgctcttactgagcccaagcccacttcttagaatctcatgctacattttgtcagctccctagggtgttttgtggtaaccaagaattgtttctcctgatccctcaccctcatagatctgtaatgtgaagatccatttcctgacaactgcgcagcagcagctggtgccctgcaatgccaagatcttcagttttctaaatgtttcatgtgaatcatgcccccaaatcaagaaatcatccaggccagaagccgcaggcttgtttggatctatgactcaaattctttttgatggtgctcttttgaaatgagttctactctgagtttattctctgtgtcagagaaatcagaagtataatatatagtgaacattttctataactgagcactgagaacttcatttgtgtcagggatcatctttatagtgacaaataagactccctttctgattcccaagaattctcaattagtgaaagtttggtttaatttctttctgttgtctttcattggctcacagattttagtgtagtacatacttagattacttttttcctgtctgttattcatcaggtcatcacctatttgatattagttccttattttttaaattattattctcattctcaggttataggctaaactatattcttattgtgtagttttgcccacaggattttccttaagttcaaactctttttaattagtatctgtatttgtattttattactgtggtagccaattaccacaaactttgtgacctaaagtgacacacatcattgtcaatatttcttctgtgatttagaagcccaatttgggatgctctggcttggaggtgaagacttgtcttttgccctgtctcgaagatgccagtgctttgatgccatagaatcctaggttctagggaacttgaggcagcagcgtttggacaacagagcaacttcaagtctaccctgtgcaacatagctaaaacttatttcaaaatataataagggaaggggagatgaaccagggggcaaaatgcttactatgcaaatgtaaggacctcagttcagtccccagaactatgtgaaaaggtaggcatggtggctttcacttgtaatctcagtactgggaaaacagagagaaaatgatccctgagggtcactacctaattatatggtgagccccacttcccagagagactcagtctcaagaataagattcagagcacttaaagaataatattgaacgttgtcctctggcctacacacacacacacacacacacacacacacacacacacagagagagagagagagagagagagagagagagagagagagagagagagaaacagagaaacagagagacacaaagagcctcaagcacacgtaaatcctcacatatatgtgaacatgtgccacacaagtaaacaaataaacatataaacaaaaatttaagatgtctggggatgtagcctagaggtagaacacttgcccaacattcacaaagccatgatctagtccccagtagcacaaactttaaaaaagttttcttttaggttctcagttcatactgtgtgtattagttatttatagttctacttatagacttttcagagttttatgtgatattgtcttgagaacctaattctcatagtttcccccttaagttaattggagatatacaagtgcatgtatatacacatttatgagaagatatgtggagtggttatgtatgcagggatgagaagtgtatgtggtatagagatattgttaaatttttcttttgtatgtgttgaaagcttgtgaatagacattaggccatattgtcagttacttaatagttttcacactgacctcaatgaattgtgtcctactcaaaagttatgaaaaaacttttttgtgtgggttgaaaatttgtttactctttatctgtatatgccattaaattcagtacacacacacacacacacacacacacacacacacacacacacacacacactattaaataccacatctcaaagaaatttttccttggagtcctttctttttaacacatccctccaatctcattttctatagcaccttgtcatataccttaaattagccagtatctttttatatattcacatcacatttttgcaaggtagataaaggaaattgctctcaagtgatgggattttttttaacttgctgtgtttcagcttaaaacatacttttccctcacaaaaacgagttttataaacatttgcgaacaggcggcataaaggaaattgctgacacaacttagctgcatctataatcgtgcaaatgatctgactgcatggggaactcaaaagaagagaggagcagaaattgggctatattttcaatttaagtctctgaatgaaaagaagagactaagtgcacttagataattaaataatttgaagtgtttggaatacttctactttgtagacacttggctagtgttccaaatagagacttgtgtctgtgtcagtggatctgtgcacattaaggatctctaaagatttaaggagagacagaacatgttgttgacctgagggttaaacttaggaccctatgaatagcatgtgcttcatcactagatacacctatagctcccagttgctttcagtgtggttccacagttcattataacatgtgtgcatattttaaatgtacgtaagtgcacactgtgcatatctcatatatatttaagaattgtaggctcttgaaagatttttttatgaacacaaatatatgtcataaattatttctgtagctctcaatattcctctctggttttgccatgtcttaattgagatcattgtggctttttaattagcttcatttgtttagtaagtttccacaatacaatattcttttcttctttaccaccagcaaaattcacatcaaatctatatttttttctatctatctatctatctatctatctatctatctatctatctatctatccatccatccatccatctatctaccatctattttctatattctacttacataatctatctataatctactatcaatctatataccctctattttctataatctatttacataatctatctagtctctcaatcaccagtctgctatccatccatcataccctctcatctactatctatttatcatttacatatcatatataattatcatcctcagcagcaatgaatcacatatgaaccaaagatttcatctatcatctatctatatatctatctattcaactatatctatcaacctgacatcatttatctactcatctgctcattcatcatctatcttatatatctatcattttgtctaaaatctacctttctgtcatatatatatatatatgtcatatatatatatgtcatatatatatatatatatatatataatctattatctatgtatcacctagatatcatctatccaatctatcatctctctcaaccatcagttaacatccttcccatcatcatcttctctatctattcacccatccatccacacatccattatcctaccagctctctctctctctctctctctctctctctctctctctctcatctatcatgcctgtgtttggttagatcagttgtcccaagattagatagaatacctacctaatatatctgccagtaatagatgctcttttatatgtgactgattttcaacaagccatttaccaccttatcagcattttcagattctcaaaataacatgatggtacaaaactgtttataactcaacttcttgtatcaatatgccaattttctaagacacaagtacaataacactattgtactaggcacctgactattacttacacatacagcagccttcagtccttactctaagtatgaggtgaaagctatgctgctctgttcaaagttaagtaatcagggcacagaaaagtgtaggaacctgcccagggaacacggtgtgcaacttgtgcaggtggattctgatctcaggagtctctagagactgattgcttaacaatcatctccaacccatttattttgtttattattactttacattgcatttttattgatagctacttattctgtttgagctactcttacacaaatcttgaagcagatcatgtccctgagggtattttcttctaccccaagtttctccatggttcatgcttgccttagactggaactcactactctgtttttccgacagagaatgtatcaactctggagagggaagggctgatcactctgaaactttcccatgtattgcagatggatctgcttccatggggacttgccatcttgaagtttttctgtacacagatgacttttcacttcctacagagctcaccactctgatgatttcccatgtatagaaggtttatttacttcctgttcagtcctggaaatttgcttagcatcaactccttcaatcattatattattctaaaaatcttgcaaagctgtttgacttaaccattcttatttttccaagtttgtagccagatactccttgggaaatgattttgaactgtttgaacaagctgctttaagatcatgtttaaacaatttatttcagtgtaattatagtgtctgcactttttcctttcctgtgctctttatttttccagatgtttcagactttgtgagaaaggtcaggttgttctcttcctctattgccattaggaagaatattcacaaaaagtatttgttatactatatttagacagatgcgtttttataataaaaaaatcaagtctagtttgggacagctaagggcaaagtaatggaggcattatttaaacattgaagtggaatgctcttgacccactgttgaaataaatttggggagctccattagcacagtttgcccagattttgttttggcattgttccttcccctcacattgtcaagaactcagccttgcaggaatattctcaaagcagagattgtttgcatcttgaagaatccattcccatgcacaggatccaggatgccatgggggtctcatttagtgtttattagagaatgaatgaatttccttcttttcagttagtcatatctagtttgccactaaaccacagatatcataccacaggtgagaaatcatgcaaaatatcctcataatctcttcatcaatgtgtgtttgcagaagtaaaacaaaagcattgagtcggatggttgcattggaaaacatacaaaataaacaacacataaatgttatttagaattacagatatgggtttaaaaaaccccacctacccagagtgcaattttctaagactggaaagtgatgacttgattttatatatgccagagagagctaatgtttgcaaaaaggacttctgagttcctctagcagttagagaaaaatcgatctcagaatacctgtcgagtccttgagatgtatcgctaagcaatcaataacaattaactctaaagatgtggttccactgaaccttcatattggcatttcagttggttgaagggatgatcctttgctaacatatgtacaacttggattaaaccaggaacaggtttaatttagttaattaatattagttctctactgtagtgctatgaaaagaaggaacagttaaggtaagatgcagatttttacttttatttatgaatttttacttaaatgtttagatagacagatggtattaaatatccagaatgattagccattgttttgaagtaatcagtagctcaatgattattgagaaaaccaataaatgtattggtacttacataacaatttcctggcatctttggaggcatgagccatctttaacacatagtatatacctttatttagtgatatcatgtgcccctgttatgaacaatgtactgtttgaaggcaagatggccttcatttcaagatcccctttcctgagagaacatctgttacccaaaatgctctgacactagaaattttctaatctttgacctgaccctcaaagtatttcacattattgatttctgggcttgtcatgtttagctactaaagtttatgcaagtattccaaaacctgaaaaacactgaagccaggaacacttctgactgaaggcttttctggtaatggatattcagcaaagtgccccactgatgaaaagggtgaggaggaagtcagaactataatgtagttcctattgacaaactgtgtcaagtttctgttttatcagacaggattaccctgaccctctcattgctgatgctaattggatgcagatctgacagtaacttttgtgcactgtaccttgtggtgttactgagactccgctcttgtcattgccgagcaaagtccaccggaattaaaggcctctaagtttggaatggttaagacaaaccattgatcactggccactgattcttagttatatctgcagaaatgtaattatatttgaagacttcttgccaagtcacctggcgtgtgtggctactctttaatcttaatcaatataggagtaaattctggttcaaagattacagcttcaaatttactcactttcatacaagtaaattctctcagtactgatatttatagtgtagctgctgcaactagtgaaatatcaatgccaacaactgagctgtttctcagatgactgtctttattagataccctgatcttattttctaatcaagggtcacaaagattcccattcatttccttctaggaacactcatttgctataaagtgtgctaaggggactcctgtcattaaaattgttaggagtgacgaccatgaaatagaactttgaaatagagtatggtaagaactctttctttatcattagtctctcaataacattgaattaggtttcttctctatcctatcttgaaaggtttgaatctcaaatccaccttcttgagatactcttgccagctgtcttggtgccaatgctccaccaatggcatggagttttcagacataggaagattaatttgctgctttggattcaacaatactgtacttgttagcaatccttggaactttctggaagttcctgtagcagtagaaaagataaatggttctgaattcccatagtatggttagaaaaaaaaaagatctcttagcatttgctgttcaggtccgcaggagacagttggtacactttgaaatggctgtatagcatcttcaaaatgaaaaacaaaacaaaacaaaacaaaaaaacaggtacaggtgcatgagtttgggcctgaaagtattaaaaggcctgatttcgtttcttttctgcttatatcttccaaagcaatacactactactatctaatttttgttgttgaagtgtgaactttgggagtttggagaatattaatttttttatattgccagaaactaacataatgtaacaatgattctgtttccattttcttttctgtatttgttttaatttttatttatttatttatgttttggtttttcaagacagggtttctctgtggctttgaaggctgtcctggaactagctcttacagaccagggtggtcttgaactcacaaagatctgcctgcctcttcctccagagtgctgagattaaaggcgtgcaccaccattgcctggcccctgtttccattttctaatcacctttgcactttagtagtcacctctgtctacagatagttaattactacttaaaattgcttggtgtcttctcattgactgtgcaataaattctctggtgtggtttatcaagatcttttacttttgagcacatttctaccttcaatttttcttcttgatcatgttttgctcacttgggcacaccataatatagtgctaccagacacaccactttttactcctgagtattttaatgtagacaactcttattttaattttttctatttcagatagatacataaaacataaaagtttttttctgctgagtagtactccattgtgtaaatgtaccacattttgtctatccagtcttcagttgaggggcatctaggttgtttctaggttctggctattacaaatagtgctactatgaacatcatggaacagatgttcttgttgtaggaatgtacttcttttgggtatatgcctacgagtgaaattgctggatcttgtggtagactgattcccattttcctgaggagtcaccatacagatttccaaagtggctgtaggagttggcactcacaccagcagtggaagagtgttcccctttctccacatcctctccagcataaactgtcattgctgtttttgattttagccattctgacagatgttaggtggtatctcagagttgcatttccctgatggctaaggatgttgaacactttcttatgtgcctttcagccattttagattcctctattgagaattgtctatttagttctgtactccactttttaattggattatttggtgttttggagactagcttcttgagttctttgtaaattttggagatcagccctgtgtcggatgtggggttggtgaatatcttttcccaattcatgggctgtcattttgtcttgttgactgtgtcctttgccttacagaaactactcagagggaaaaaaacaatggaatcttgaaattcacaggcaaatggatacaactagaagaaccattctgagcgaggtgacccagtcacaaaaagacaagcattgtatgtactcattgatatgtggattttagacattgagtaaaggattgccagcctgcagcccaggctgctggagaggctggtaaacaaggaggatcctaagagagacatacataagatctcctgagagtgtagacacagcatacccaatcttatgggacactctgaaagcagttctaagaagaaagttcatagcactaagttcccaccttcctggcagaatgtacccacagatgtaagagttgcatgactgttattggggtgataacttactctcaattggatgtgagaattattctgtaagagagactatgcccggcactgtaaccctggttagaaacccctgacttaggaagtcatcaaacctaatatggaatctgctactgctgtttagtaaaattggtacagcaccaaattgtcttttaactatttattttatacccacagaggaaggctacttttagcctttatcaaagaaacttctcttttcagtaaagggcattgaatgcagagactcatggctgctcagacacttaagagtaaatggtaattgagtgcttagtgtaaatggttcatttatatcaccccctttaaggctcagggaacaatgctggagagaaaaaataatgtaagaaccataaaataaggagactggctgtataatactatctttaaagcatgatacaaccattgcaaacacaatctcacaattgtgtttgcagtgggtctgattaagactaggactaccaacagttaatcatggggtaagaagaggttcatgagactctatccttctctttttactactgaaaactgggaaagatatagtcactgtcttctattgcattctaaatagagaccctaccagcagccaatggatagttctttacccatggtcacacagaagtccctgtggtaagtgatcaagggaaatctacacacaaagaagacaaagagaaatcaattccaccaggacctgcataggagaagtctgttactcttttgtgggtaacaaaagtatctaggccttactttcaagagaaaacagcttgttggttccaatgttgcttttgtatctactgtaatttaaaataatttgtgatcagagccatatagtcaatagcttgagattaatgtcttaaacactttgtaagatagttggggaggttgttccctgtaaagtttctttcaggtcagctataattcaatatgtgaggacccacatccagctgaggaactgacaaccaatggctactgagagacggagagtcacttttctttagtagtgtgacccatcataggttgtccaggttctactggagggccctgcaaccatgcacatacagttggcactaattggacacagcaggttattaagaagaaagaagacataaatctggagggtatgtttgtgtgggtctgggaagagttggaagggaagagcaagggtgtggatgaatgtgatctcaatacaatgtactcatctatgaaattaccagatagttttgaagtatataaacagctttccattacttttaacaataatatctggaagtagcccaggaagtgtgaacaaagaggatattttatgactaacatttataaagaatgttttttaataaaattttcatttcaaaatagttttagatttacagaaaggttgtgaagaaaggtttacatatagcatacaagttttatctcttatttacctctgagattagtatggtaaatttttgcaataaattaactaatatacataggtattaattaaaatatacccatacattattcacatttccttagtttgggccctacattccctttcagttatagaatcaaatccaagttatcacattgtatttaatcaccatattcttttggattcctcctggctatgacaaatattttctttatcctattttattttaatggcctgacagttccaaggagtgtaaaccagttactgtgtagaatgtccttcatgtaggatttatctgttttcttatgattaaacttggggcatgcagttgtaggagagccacagaggtaaagtgccatttttatcacgtagtatcaagggtgcatgctatcagctatcaacatgactaccagcattgaccttgagcacctggcagcagctgtgctgtcagctttctccaataccatgttactctgcaaaaaagtcagtatgcacagtgcatgacaaggaagggtccatcttctcaaggttggagtcaactacttaaattattttggatttttccatacaagataatagtctgttattttaaaataatttattaatgtaagtatatatttatgtgtttgtatttcattttatattccattatggctttattgattagattgtttgagctgtctcagttttggcccctgggagactgtttcattcccatctgtgtccctttgacataaccacataggttttcattagaatttccttaatgtcttctactgtaataaccactagaaatattatgtatttatttcattagacatgaaattaaccctttattcaaaccccgattccctttactggccaatggaaataggaaataagaactttactctgggagttcatgattattggactgtcactgattctaatctccctcacatgtcaggtcaagcaaatacatatgtgtatacacaaacttctgattatagaaatatctgtatttccttatgtgtttatttatatctttatgaatccagacataaatgcaaatttcttcatctctaattcaagctgtcttcccctgctgatgggaactcctattccaatagaaactgaactctgacccttggtgattaaattacttagttgtccaattccagtagaatggtttcggaattgctaagctgaactcctacaggaagcaactttgctaatgagatagtggatagtatgaaaagttcctttgatgtttgacttacagtctctatgctttttccagtgttaacagaggtcaacgcctctttccactgcccctctggtgaggttatttctatgtacctgtgaaaggatagatgctttatcaaagtccttctgatatatcaagaactcagaaatgatatttcctcaatttgatttcattaaggttcactctatgtgtgataaaacttttgtgggtcctaacaaatgcacggacagtatcatgtagccaccattatagcatcagacagaacaaatttttattgacctcacaaatacaatgcacataactgttcaactctgcctcttttctaattcatcatgattgccagcttgatagagttgcatttattcaatcctaataatgcagtattacaatgcatagcctttcagatgggcttttcaaatgtagcaatatagatgtaagagtatgcctctcttctgaattttattttacataatggaactctttggattttccacatttatatttcaggggaagatctttgttgggtagtatcagtgtactgactgtggcatgtagtctatatcagatatccacagttcaattttgcacatctgatttctgaattcctcaactgtatatctgtcctggaaggctgacatatatagagtataccatagcttcctttgtcttttttatttagttttattaagccaatgagcagctctgtaggaaatggggtgggggtgcaaagataggaagcagggttatacattactatctttctccttcattattggtatcctgttttactacttaaacatgaagtttgcaaatggagctccacaagatctgtcacttcattgttcctcatcactctgccttcttgtctcttgtggcctgttggtaacaggatagtggcaccaccctatccccaaaccatgtctaaccctttataagcaatttttattaatcttttatgaattataatatttttgaatgtgccaggactttcttgttggaatcttaatgtatctcctgattctttcccaccatgtgttgggagctgcaaagtaccgcacccaaaagatggcgccggtttccgccttccaccgccagcccgaaggcaagtgctctctgtggtaaacaactcctaatttggtaaagatcatgtatcctcttaattctgcttggagacaaccaatcctggtgcaccacgtagggttaggtgattggtagatgtagaaggtgattgaccacgtagggttaggtgattggtagatgtagactatatcaggccccgtctttctctacccggggccgcaatttcactgtaaatcaagaagttcctgattaaactgtgttgaagaagattcctcggtgttgtgtcattcttgttggtcaaggatggacttgacaaccatggtcaccctgttggtttaaagacagaaatcacaagatcatctcaatagagacaaaaaagcatttgacatagtttatcaccacttcatgataaaagtcacaaaaataggaagagaatacaataaaaggtaagtatgacaaaataacaaatgctgaggaaaatattaaaacatttcctctaaaacctataacaagataagaataaatattctcttataccttattcaacataatgatctaagtatttgctgggacaattatatacaagaaagaaaatcaaaagagatacagataggaatggaattgttcaaatcatttctatatgcaaatgacaagatcatatactgaaaagaccctaaggagtccatcagaaagctcttagatttgataagcatttttattaaagtaacaggatgcaaaattaatatatacaactcacagatgttcacaaataacaaacttcccaagaaagaaatcaggaaaaaacgcctttcacaatacctttaaaaaatacgcctagctggagagatcactcagagggtaaagacattaactgctaaaccttgtaatctgaatttgattctcaggatcaaatggtgtaaggacaaaaccaaatcctgaaactaccctctgcccctcatgtactacacatgtatatcacctcatacacacacataagtaaataatgtagttctgtatatatgtttaaattaggtatatatgtttgcacctagatataaagctaatcaaggagatgaaagacttctgtaatgaagacactgaagagctacattgaaggaggctctagaaagtggaaagtgctcttatgcttatgggttgataggattaatactgagaaaattgctatagtactgagagtgtcataaaggtacatcaaaattccaattaaattactcacaaaactagaaaaatcataaagaaatacagatgattctgaataaccacttctaagtagggaagagcactgccagaagaatcagtgtttgaactcaaatcatattgtagagcccaagtaacacacagcacaatactgcatcaaaacagcacacatagactgatggagcagaaataatcctacacagctatagctatgcaatttcttgagaaagatgttcaaaacacacatggggaaaatgacagactcttcaacaaatgtccccagggaaacttgatatctgcatgtagaaaaatgaaactagatacccatctctcactgtgtacaaaaattatttcaaaatggataaaagaccttaacttaaaaaatgatttgaaatgttgaaatgtnnnnnnnnnnnnnnnnnnnnnnnnnnnnnnnnnnnnnnnntcacaggcaagaactttttgaaaataactccagtggcacacaaataactccaagaattgaaaaatggcattatatgtgatcaaaaatctctgcacaacaaatagagtctctagagtggaaagacactccgcagaacaagaggaaatccccagctgtagagcagtcagagaagagtacagtagactatgtagcatggggatagaagggtagttactggatttgggaggaaaagagtcagcaagaggtgatgagggggctggggagaaaggggcgaaccacttttgagtgaaaattccataatgaatttctttagtgtgtatgtgaacttaagacattaaaaatcacacaagtatctctggattgatactccagtggcatgttcctagtgtcattatgaaaacctattgtgagtaggtctgaaaccttatctgttgcctgtctcctatggttgaagtcactttacctaatagagtatgaattgtcctgctcttctaaattgcattgtctaccctctttgggaggtcagggagatttcaagcccagtttatggcatttttgcctgagactaggagtggtgtatgcaaaccctccatagagcctttcagaggactttggtgagtgaggcagctgttcttcctgctagcttggtagtgagtgtagaagctcagatgaagccagagaagaattcaactctaggtatagaatggctattgctaatgtgaaggtattaggtctttctgtagagtgagtattagaggtgatcaatcacagactggtggaagcttctgtaagtgtttgatctcacataataacaaaactgttaaaaaatgaatcactcaaaaagatcacaggaaaaaaaaggaattttgtttccttttcatctctttttaacattttcctaaattacacagccatttattgtatgctccctgtacacctgttattgtgctaaagcctttgcacaagttgtgtcatatcatcctgcaatactgcaaaagtgctacactgttgcaccctttgcatgttgattggtattcaagacagacaaagtagagtttgcccaaagttgtacagtggggatgcctgcaactaaggaaaatcaccacccagcgggtaaacatcaggagcaactgcagaactgtgaaagtttcagggggctcctgatgatcctgtttacctttggggttacttcctttcaatgtaagattgatgcttcttgcctgcaagtgatgtatgtgagtgtgtgaatgatgcatatctgtctgtctatctatctacttatctatctatcatctgtcatctatcatctaatttctgtttttttcccctccatgttttattaatttattttttacattccaatcccaatttccctcttcctctccccctgcctcccaccactccccacttctcccatctactccagagagagggtaggactctcatagtctactaagtctgtcccatcatctagttgaggcaggaccaaggcacctccacaccctgacatggttttattaaatgatgacatggttttattaaatgatgtcatcttgacttgcctttcatttactctcttcttcagggttcttatcttgcatttccctactaaatcttgaattttcttgtctatgttatgtgtcatggtttccacactaagactttttgtttgtttgtttgtttttggctctcaatgcttgaatgaacttgagggatcaatcatgaagcacttggcccactgggacacagtcctcacttgaactggttctggctgtggccttccctggaggctttcttttatgctttcctcttgcttctagaacattactctgtgaccatcctctgtaatctgatattaccacaggaaagacgacctagttgttcccatatcacttacgatgcagctacatttttggagtaacctctgagccttttaataaataatatacacacaaccctcctgtttttcagtattaggaaaatttcattctaaccagaattctgaggtcaggtctataggcactgctgaggcatctctgagtacagagaattacatcagaacaaagaccttctgctttggaaagagttatcaattttaacaaataaaatataatactccactaactttaaatttcagataaatgacagattttaaaaaaatataaactatgtacaaaatattgcttgaggtacacttatgtagagaaatggttgtttgtggacattcaaacatagcttgaattctgaattttatttagggatctaaccacagaatgatacccctgtcacatttatcaccagagacaaccatttaagtctctgttacctgatggcatttgagaaatcgacattaccctataacttattcttactcttgtgttgactttccatctccttggggtgaaatgatcctggggtgacattatatcttgtctgtgtgagacagtctcattttatttctgttgtcttgacataattgctaacaatcttctttcactttcaaacatgtctaggtttaggtgataaattatatggtcattgatgcctcattccatccttgatttcctcctgaccttgttagtaagtaaatttttagcttccttccctcaaaactatactctgagattagtcatcaatttgactgaccttatttcttgtcctttcagtcctgtgtctcacctctatgcttaaggtagctctctctgtgtctttctgcctatctcctcaaaaaccattactagtgtcttttcctttctcttcttatgcaaaaggaagcagaaattaagtacatgtttgatgagtcagtgaatccataaagtccataaaagcctaggaaatacaggcaaatgacatataattgagaataatttgggaattttcacttaaagaagacacaatggtaatgatgtctatatagaaatgattatcattgtcacttcttaaagtgaaaattcctaaatacatatatctatacatataacatatatttatatattatagatggaccactaattaaacgagagtcataatttgtgtggaagtaaaatgattttctttatgtaactttggacaagtgtttccatttcacagtggctatcatacacagtttctgtgttacgtgataaagcataacattattacatgtattcctgtgaaatatcaaataccttgagtggttgatttcccttccctcacttaactgcacactaaaacacaagttcatgtatttatatatttttatacatgtaaacaactttgtaatatattttaaaagtgtctaatgggcatgcgtacagctttcatatgctgtgaactgtgggcagggagagttgtgtgctgaatccacactaacctatccttttcacaaggttctaattactgatcatcagaaacaggaaattccaattcaccagcccaccaaacaaaaaccaaacccaaagaaaaaaaatggtctattttgagagagagagagagagagagagagagagagagagagagagagataccatcagtagccctgacttttaaaagacttatataatcttaacataagccaaaatacaaggggtattcaaaatagaaacaagaccatttttcaataaaagttaaaattgttagactattcattattaatttaagcactacaaattatttagaacttattagaggaaaacaaatatgtcatttgtttcttttgtgttaactcatccaagctaaataaatgtaaggatttattatatctctgaagtcatgattatatcttacttttagatagtaaaataattgttgttgaatttaaatcgaatactgttttggaaagcttaatttgaaatattgcttctattttcagcactgtttgaatgccttcaaggaaaattgtggctgttttatgagtatttataagtgatgtatattgatgaaaaatggagataaaaagtagaatgttacataattacttcactagtataaagaaaagtgtcaataagaacatgctaggtgaacaaaaattggttatgagaaggacagatattttaatgacctgtaagaaagagttgttctatctcaaatcaaaactatgttactttctataagtggaatttgaaagcaaataaatttatctaaaatttttaggatagaaggaaatgaggttgtgtcaattttgtcttttgcaaatgtttctatggaagaacaaaatgtggtaagcatattgtacaaaagaaaaatgtgcaaatactaagcagcagaagaaacacaatcctcttagtcacttccttatgttgaattaaatatttactctaattgaattatatcaatcagtagttggcaaagtagagtcactggccaaaaaacggacagccagctgttgttagaaatagcatttgattgaaaaactgccttgcttgttcatttaggtgttgcttattgtacatgtctgtacacagcagataagctactgagatggaccatataccccataaagattgcatttgttactatgttttatttttaaaacattttgtatgttggggcaggggcataacaaaacatattgtatgtgtggggctcagaagccaattttaaggggttggttctatcaactcaatcagtaagtacttttacccattggggtattttatcagctctaccatatgcttcttttaaaaaaaagttttattattgtttttaaaatcatgtgtatgtttgcaagtctgtgcatccttgtgttcatctgttttcaggttcctacagataccaaaggaggatgtcagattccctggagctaaagtttcaggcagttgtgaacttgggtcctttacaacagcagaattcatttttaagcacttagccatctctccagcctcaccacatagtttttaaaaggcagcattatcaggaactactttaggtcattggcttaactctttggttttctagatgtattctttgtatcatcactatacttaattcatgaaaaaatgaatttccataaaattggatgatactggaatttttatttttctatattcatctgtgtcattaattgcataaaatgtttataggatttacagtggtcagtttataagatatagtcaatacaaagactataatgctaagatttcatgagatcatcgggagggtattgtgcaggcagattattgaaacatagatgtatgtgttcattcatttattaagcatttcagagaaagtgcagacattaggtgctgatgcagacacttctattcggtaaaaatcgacacactatatatgcttgtgaaatgtatgaaacctgaaataagtggaaatgaagcagcatatatttataaattataacaatgctatgaaaagtgatcagagtttggtgaaggagatgaatgtgagggcaagtttttgtgccattgccaagtatccctggtaacttgcttcagttgtctactgaaggttacccttcaatactttcataaatcaccacagttatttatcttgtttccaattctttggttatggcatggcttggcaatgtggttactttgctgcacagtgtgttgtatagagtggtcctagggttagggaatccattatttcttggctcattcataccagggcatgcttttctttgtgttatgtagaagctgtcagtagcttggggactgagcatcagcttctcaccaggtagatttcttgcaaatcacttgagcttcttctagtatggtggctgagctctgagagtgagtgatctgagaattatgcagatgtgaaattgcttcctatggcccagcatcagaagctgtacaagtaacatggcatcatcatttgcactgaggaaacaagcccacccagaaacaaggggaataaaaagactccacatcatgaggggagaaatatccaagtcttgttggaagaagatagtatcattagactgtaatgtaatatgaccattacattttgtcacagactataacaatctataccattatattaaaatctagatgaaaataataattcattctaacaatggaaagaagattgtcagcaaatgtgaatgccccaagcaagagaaagacttgatatgttagaaatctagatgaagtcaatgtggtaagcaaggagaaaattgaccaatgtcacatgtgcggtgtatcaatatgtttgatcattgtagccactttattgcaaggctgggctttcaaaatttatttcctagatgagctaagaagggcttgaaagatttaaagcttgatagggataatgattcagtgtccttttctgaagctttctctgactctggtgaacagtggataaaaaaggagctcaaagtcaagctggtataagaggccatcactgtggttgtagagaggccttattgtgtcttagataaatgatactgtagaaataaagataaagaaagaagtcagatcagaaaatgctccatagtggaagcaattgaagaggttgtgagatgtggggaatgtggaagaatcacttagagacccctgtaatgaataaataagcattatggtagcatcctttgcattaactggggctaacactaaataaggggggcatgtttctagggagtatgatcaagagttaacttagcaagtgggaaatctgagctccctctggccagcaaccaatcatcaggttagcaagtcatcagcatgtgaatggtgcttaacatagtgggatcttaacatcactcaccatctagggaaggaatacagagaggaggtaggaaactaatggcaaatcctcagggtggtggtacctgaggagagagaggtcatgaagagaccaacactgtgctgagaagagatacacagacagattggaggatttcaaaactcaaaagaccttctggaaatactggaagattagtgtgtgatccaagacccttcagattcagcagtgtagggatactggcattcctactagtaccagagctgatacctgtgtttggctagattacgtgacaaagaatagatccgagtagggagaggtggtacgcatatatgaaatgtgacatgggtagcaaaggcacaacagatgcattcaggcaaagatctgcagtcaatgagatggttaaagcactcagtggaactaaaatggtctaataactcacacaggcagaatggtttttacctggtgactgatattctttttttttttttttttttttttttttttttttttttttttttggagaccaggctggcctcgaactcacagagatcatcttgcctctgcctcccgagtgctgggattaaaggcgtgggccaccaacgcccggcctgactgatattctaacttatgctcaattgaaccattttcatgggggcttctgcaatatgatctaagcctccatctattttcaaatgaagacatggaacaccattcagttcagactagcagatcatgtcttttctttggcatgtttagggttttacaaaatgtagaccaccaaactgtgctcaaaacaatgttaaacgaatgttttagtttttctctgtgtctgacaatatgatgaattcacagacataaactagactcaagttcaggtttgtcagtctccatacatcttcaaacatcattagctaataactaggcttgcccattcaacaaaacttctctattacttctttgactagcaaagcagtggtagctagcatctataaaacaccttttgttagcaggtaatattttaaggactttgcttgagttattatatttagttaccacaccaataatctgaaatccagtctgactccagggctctctactgtaacacacacacacacaagaaagaaagagatagaaaacttttatttttggaatttgcaaagttgggtgaggtaagaaaagagggaagaaagggagacagctgctatttcaccactgatccattaagccctgttcagaggcttgggtaaaaatccaagccatggcagtgtcttgacaggttctgggcagcaactgatgggatgagatttgcctctgatgtatagttggcataaagcttaaaagagcatccccagaagagcatgagttttataacaaccattgcagatctggaggccctccctgttctcacctttgtttgtgcactccttctctcattgtacaatgtcttgcctaaaatggcaactgtgattctttcaacatcaatgaactacaagcagttaataatgctaaacagaaacttgaaggcagaaaaaaagtcaagtaaacccccaaataaacttgtctgaggtctattttattgagatttgctgaaattttacaaacacatatattaagaggcaactcttatggttaaaccttcctaaatgttgctactcactccttcttcctatgaagcctcttgaccccatttagtaaggagtgcctgctctgtgttgttggctgtcttctctgtgcataccctgtccaaagcactttggtctccagggaatgctgtagcactttcagtgtaggggctgatgctctcagtaccttgcatcagatgctaagtcatttcaccatcagtaacaaatcctaattaccctggagactcaaaatttttaatttgccatctatccagccccatgttgactccatgtgataaaaccaaactgtattgttcttgcttaaagcaaaacattgtttgcatttaatgtattttaactttctcttctttaatgatcaaatcttcaataaactcacagccaagattcataaagaaaagtgagttataaataaatatataaaccttccttgacctttacatgaaaacaaaatcctaaatttggaaagtgaaaagttaatattgtatatcttccatcaactgattgccaaacaaacccttctacacttacagaattggctaagaaggaaactactcccttggttcagtttctgttgactacagggtataattacatctctgactgcagggtaggtggaatctgtctgattataatacttacttgctcagttacagagggggcttgtctgcctacaaaattaacttgaagcatcttcagtcactcagtttgacattgctcttcaaaggcaggcctacccaatgtttatgggtaaaaatagacctaatgtgaaaatagtttcataaaggggtatcaatgaacagaagaatggttccctgcctagtccaaggcttcccatcctgaatgatatctggtgtgaagattcagaatgaactgagatggggcccagttgtaccctggccattcattcagaagcagcttcatggaaatacaaataagggctgacacaaagttgaatctttttaaatttaattgtgctcatttgtccaagaactctcccttataaatggaccttagctttgcatgggaagtgtggagtgtttgtttcagccctaatcatttacagtagaagtttaaactcaaattcaattcacctagcttaaaattgtgaatctaatactgtgatatatctgtatgattatttattaagttgtagaattaagtttaaattgtatagaattaagtataaatttcttctgtgtgttatttctataaaagtaaataacttttaatggcaaatgaagcataacctttaaattaccaattttataaattttaagtaattttgatatttttaatttttcaaattacatttgtttgttttatttgcatctgtctgtatgtctgtgtgtgtacaggcacatgcatgtttcatagttcatgtggaggttaaaggacaacttgtaggagtaagttcttttcttgtataccttttggcctgagaaactgtactcagtttgtcaggcattgtggcaagggatgttagctactgtgccatctttatacttctgatgaaaaagttttaaatggagatccttttcttttaaacttcaagcacctccaaatatgagatttagaaaagactaagtaataccttcatgcctctcttccatggtgattgtcagaatatagtacagtatggcactgagagtggcttattatcaatactgtagtcataagcctgttgtctccctgtttcacagctgatcatgggttatctacattcctttctagtttgcattttcttttggttaagtttaattgttttccttttaaaatattcgcctccctagaagttcaggtaccagaggacccaaaataagagttttaaaagaaaaatccctgttcacacaggagggaagtgtttatgccccatgacctgagatcctgtttcttctccattgtattctaaaggattctgatgtccaaaagtcagctgcctggataaccagtgtgttattagttaatgacaatttggtggtcaaaattaaaggaagacatcctacacatgagtcaatatatgcttgtggctttaagaaaccttcaagttttctctctaacatctctatagtattggctagatgcttgaaagggggtagagaaaaatgatataagtttggcaaattgctgtatgcagtttcataagcaatgaacaaaaaacataggaattttcgcctgtctttgggcagatggtgaatgcaacagcagagatttcaaatatagatgtagcacatacatactgcaaacagctgtaatagctaaaatacatgccagaagacttagtcatcctggatttccaccccccccaatctaggctagccttcaaaaatagacttcttctacaattgctatagaattatttggaagaggcaagtgaattatgatagaacaatttcgctgtgtgctgaggaggctgaatcttgagttctcctccataactggttgaatatcagaactgttatttgtgatttgctaagtgtaactcatggccacaaatgaaatgacttctttttttaaatttttttatactgagttatctgaaacaattttctggttatctgaaacaattttctgaacactagtagaattattatattattatttggaaacttaaaaaaatctgagtattgattttttctttaaaatgtttttcatatgacatatattttggtcacgtttttctcctttctccaacttcttccagagtctacctccctacccacccaaccttaatctctctctctctctctctctctctctctctctctctctctctgtctaaaaatacacaaaataaaactagatttgattggcaactaggtcatgtcaattttttttcagcagattaggaggcataaatacatactactttagaaattttggggaaaatctgtaaaacctccaataacattcttagtctccagatgttaagcttgttagaattatgccagtcatcaagaggtcagttgaaattattctggctcagagtaattatctggcttagtcttaactgacataaataaccagtgtgactttcaccagacatttcctcagtgagtggggattacatttatacttcccattttagaaatgaactgatgggagacatctttctgtaggctgtgaatatatgtttctattattgtttgatgactaaagctgtttggccaatggacaaaaatgggttaataattaagaaagagacactctgaaatgtgtcttcaaactcttggtgacaaagggctactttcgtttttcctggagtcctgaagtttatggggaaggtgagaaaattctgtttatgtgtctgggttccaaagagaagtgtccaatggggggaaagaacaaggccagaaaagaggtattgtgcaccaaaaagaaagaggggttctcaagtttctagcaagaaagcttcaaatgtcagcaaactgaaatgtggggaatagctgaagcccatgtccttaactcaccttacaagcaagcattgaaataagacctgagcattcaccaagttcatttggcaccatcaacttgtttgtttattgtagatggaagtttctgtcccactaaacacacagaggcttatattaattataaactgtttatctgatagctcagactacttattggctagctctttcttaattaagaacccattttttaaaaaatctatgtatctacacatggtcttggcttactggagattgctcaagcattctaccttccaggtagctacatggcatctctagagactcactctgtgttcctcttcccagaatcattgtgaggaccaccagacagaaacttaacacagaaacaaaggatcttacagaagttatgacccaaatgagattaagagacatctatagaacattccatccaaacacaaaagaatatacctccttagcgacacatggaatcttctctaaaattgaccacatatttggcaacatagcaatcctccatagatacaaaaaattgaagttaccccttggatcttatcagaccaccacactataaagttagaattcaacagcaatacaaattgcagaaaacctacaaactcatggaaattgaataacacccaattgcaccatccttggtggaggaagaaataaaaaagaaatcaaagacttcctagaatttaatgagaatatagacacaacatactgaaactttttggacaatttgaaagcagtgctaagaggaaagttcatagcactaaatgcccacatgaagaaactggagaatagtcacactagagaattgacagaacaactaaaagctttagaacacaaaaagcaaaccctaccatggaggagtagatgccaagaaacaatcaatctgatggatgaaatcaataaagtagaaactaggaaaatattacaaaaaaatcaatgaaatgaagagttggctctttgagaagatcaacaagatagacaaacctctatccaaactaaccaaaaggcagagagagtgcatgctaattaacaaaatcagaaatgaaaagagagatatagcaacagacactgaggaaatccagagaatcatcaggtcatgctttgaaagcctctactccataaaatttgaaaatctaaagaaatggacaattttctggatagatatcacttatcaaaattaaaccaagaacagataagcagtttaactcgacctataaccactaatgaaatagaagcagtcatcaaaagcctcccaacaaaaaaagtccagggccagatgccttcactgtagaattctaccagaatttcaaagaagaactaataccagtactcctaaaattgttccacacaatagaagcaggaggaacactgccaaactcttttttactaggctacaattaccttgatacccaaaccatacaaagatacaactaaaagagagaactaaagaccaatatccctcatgaacatcaatgcaaaaatactcaacaaaatatttgcaaattgaatccaagaacacatcagaaaaatcatccaccatgatcaagtaggcttcatcccagggatgcaaggatggttcaacctatgaaaatccatcaatgtaatacaccatataagcaaactgaaaagaaaaaccacatgatcagctcactagattctgaaaaagcctttgacaaaatccaacatcccttcatgataaagatcttggatagaatagtaataacagtagcatatctaaacatgataaaagcaatatacagcaaaccaacagccaacatcaaactaaatggaaagaaactcaaggcaattcctctaaaatcaggaacaagataaggctgtccactctcaccatatctcttcaatagtgtatttgaaattctagctagagcaataagacaagaaaaggagatcaaggggatacaaattggaaaggaagaattcaaactttcactatttgcagatgatatgatagtcttcataagtgaccagaaaaactctaccagggaactcctatagttgataacacctttagcaaattagcagtattcaaaattaactaaaattatcagtagccctactatatacagatgataaatgtgatgagaaagaaatcagagatacattactcttcttaatacccacaaacaatatacaatatcttggggtaatgctaaccaaaaaagtgaaagacctgtacagtaagaactttgagcctttaaagaaagaaattaaagaagatacccgaaaatagaaagatttcccatgctctcagataggtaggaccaacataataaaaatggtaatcttgccaaaagcaatctatagattcaaggcaatacctatcaaaatcccaacacagtacttcacagaccatgaaagaacagtactcaactttatatggaaaaaaacaaacaaaaaacccaaggatagccaaaacaactctgtacaacaaaggaacttctcgaggtatcaccatccctgagtacaagctctattatagagccatagtcctgaaaacaggttggtattggcacaaaaatagacagatagaccaatggaattgaatcaaaacccctgatattagcccacacaactatgaatacctgatttttgacaactaaggtaaagttatacaaaggaaaaagatagcatcttcaacaaatggtgctggcacaactgcatttgtacttgcagaggattgatgatagatccatatctatcatcatgcacaaaaattaagtccaaatggatcaaagaattcaacataaatccacccatattgaaacttctagaagagaaagtgggagatacccctgagcaaattggtagagcagactgcttcctgaacataacaccagtagcacagacattgagatctacaattaataaatgggacctcctgaaactgagaagcttctgtgaggcaaaggacacagtcagtaagacaaaacgaaagcccatagaatgggaaaagatctttaccaaccattcatgtgacagagggttgatcaccaaaatatacaatgaactcaagaagctagccaccaaaacaccaatcaatgaaattaaaaagtggggcacagaactaaatagagaattccggagatctacaaagatgacaccaactgacaatctaggcaatgttggagatgataacttaaatgcccttcccctataatgagactgatgactattttatatgccatcctagagcccttatccagtggctgacgggagaggcagacacctacaggtatacactgaactgaactctggaacccagttgcagagagagaggaatgaagatcagacgggtcggggccaggctggtgaaacctacagaaactgctggcttgaccaagggggagcacatggaccccagactgctgtctgggaggccagcacaggattgaactagacccctgaatttggatgtcaatgaggaggcctcagtactctatggagtccctgatagtggatcagtattttccatggtgtaaaaagggactttgagagcccatcccacatgaagggatgctttctcagcctggacacatgggcaagggtctaggcccagcccaggatgatgtggtggactttggggagcccccatggagggccctaccctccctggggtgtggaagggggatggggtggagggatggtggggggttggggaggttggttgggagagggagaagggattgacatttgaagtaagtttgttcctaatttaacctaaaaaaaaagagcagcaatggaaaatgttcaagtaacatagaaaggcaaacctaccagaattacacctgaattttctgtggaaacactggattagtagaatggataagaagacagaatgcatccttctgctgtaaacaagaaacacgcctcaacttcaaagacagatggtacctaagaattaaagtttgggaaaatatttaccaatcaaatggacccaagaaacaagcagatttaccatccaaatataccttcttcttactgccacatggaaccttctctaaaatcaaccatatacttggcaacatagcaaacctcaacaggtacaaaaaaattaaaataaccctttgtatcttatcagaccactattctttaaagttagaattcaacaacaacacaaattgcagaaaacctacaaactcatggaaattgaataatgcccaattatactgttcctgggtcgaggaagaaataaaaaaaaagaaattaaatatttcctagaattcagtgagaatatggacacaacatacccaaacttatgggtcactctgaaagcagtgctaagaggaaaatttatggcactaaatgcccacatgaagaaactggagaatagtcacactagagaattaacagcacaaccaaaaactctagaacaaaaagaagccaacgcaccatggaggagaacagagaaaaccaagcagagctttggcaatgaatcctcagtctggttcatgtttgaaaagtggagacaccatgaggaagttgtttgagaacctatcagtgaattgcatagtctagaatgcccacagaacacactcttgggaaggtgccacagagtatggtacaatcgatctggagagaatgtctgtgctaggactcagtggtggactgtggttcctacaggcaagagagcaaagagagcagatacctcagttggtgacaagcctgagggagatagcaactgcacactgagatcaggttgctgtttcagttctcagagtccaagacagtgagctgctttcactgtggttacttatgtcctcattcaaagaacttttatggagtatgacttaccttgggaggcatagttctaagcactgctggaaattttcctaaagaagagtaaggactttaaatcatctctattgcttgcatcaaaatttagaacacgggagatgctcagtgaataagataaaagagactctagaattgaatggaaactatataataataaaataccaaatgcattctgtctgcattaattgttggattattagcacctatcattgaatcaaacaatctccatttctcatgtatgttatgctaaaatcaatgtatatatgtatttgatataataaattgatttcatttcccccttccattttatttttgttggttgtgacatgttcctgataggttcatatatttgagcatgtgttctctaactgaagaaataggttgctatggttggtctttgttgtttcacaacctctttctgctatctgctgcctgattatgaataaaatgtgaccagctgcctcatgtctctgtacccatgatggccttgctatccagtaatcccaaatcacttctttctttcttgaagtagctttttttggtcaggaattttattacaacagcaagaaagatgacacagaaatgaattcaatccagcaaggtggcagctattttttagtgtttgacaaatggattatatatgtcatgactaatgtagaaaggtgtttacttctgtagtaaaccatggaggagatgagatgtaaatatgatctttgaatatcataagaggtacagcattttcagacattccaaaaggacagatattctttactatgggagacaggacagatgtttgatgcagtctatcagaattagtggacattagtgggtagcataatgtcaagattaacatagctatgtctcaggaatcctctcttggatggattggtgcagttgttatctgtgtttcagggaaccacttaggtcacgggagatgggtggatttggggacagaatgtgacttgtagattacaggatcctatggggggcatggagcagccttctttttcccatgctgttaatgcactcatataaggcactacatacatggtaacaaaacacttagacacataaaaataaatacatggataaaaaatgatgtttaggacagaatacggttttataacagcagttatataagatatactttctttaccagatgtgaaagtttatttttttgatttttactcatttttcaggtattcaaaaaattctgttttgatccaaagtgttttgattctagaattcaattattctgtacaccaatactcatattttcatatatatacatgtacacagatagcccccattataagtttaaagttagtgaaaatgatcatttctataatgtacattaagataaaccatagccactaaattcttgtcagatgctttatgaaacaagcaaaatgaagaaagaaaacatggaaatgtaagctaacacattaaaatgtgtgatttatattaagaagttaccacagagactgaacttgctattcaggaatcattcaatattttcatccctgaagtaatttactcattttaaatatgagaagatattttagattgcaaccaggcctgaacatgtttctttctttttaaaaaattcactaccatgccctgtagctagaaaatggaagatggaaagagtaatttccatgatgtgttttctgaagtgaaggttgagttgaggcaacttaataactgcacttaatgtggagttttctacacacatcccgaatttccattttaccactcttaactaaaattgcaatagtggagagttattgataataaaaaaattaaaatgagattcctagttatgctttctgaatattttaccattatatagttcatctaatgaatactttatagaaatgctagttttagtttaaacatttcatagcaaaaatatgttacaatcttgcctaggattggtctatgtataggatagaataggctactaggaaaaatatacagctattttaatagaagattaattttaagagcagataattataacttctgaagcaataataaccacattgactgtttatagatcagttatatcttgtttactagccaggaagtctgatgcaatccattattcctacctgtaaggagtatgttttcaatctggacccaggataaaacagcccccttctctctgtgcaaagaataagtaacaaacatttcattcataatggctgatattgaaaaaaacgttctacctagactaggaaggacacaagatcacaaagttgaagaaaagccagcttaggtcaccatagcagctacttttgagagaaaaaataaaccaaagtctcctcgaagataaaattgctaaaaaaactagaatctgaagtgagatataagcaattatctccttaaaggggaaattttaaagcaatagattctctagtacaggaaaatgagacactaacatagatcaaggcagaacaaaaaattgtgaacaaagacttagtgtaaactgaagaatcataaccaactcaaaccaaggccattctttagttaaataaggagggttttttaggtctctgggaacagacctaatcattttacaactccatactttttttagttttatatagctacgcaaagataaactacattaaacaatacttttcattgcatgtaagagtttcagttatttcccaaacttcataaatcttctagttcagtgcctgtattgaaaggacagagctacagcccaagcacagatcactcatctagtagacagaaggcctggattcaatcctcacaatctccgaaattcagtaggtcattcagtcagtcaaaacctgtagccctgtggatgtgaaatgggctgacatgtctgtagcaatttctaactgtggggatgtattgtttatgatctgataaagccactgaagatcagaatgcaaagccatggaaactgggcattggtggcacacacctttaattccaggactcaggagagaggctgatggatctctgtgagttcaaggccacccagggctacataagactgaatcagtctcaaagagaaacagagctcatacctctaatcccatcactagagagatatataagataggggcaggccattcagtaatcagtcttaggcaattagtctccagccatggtgaggtcaggatttccccagccatcggtgaagtaagaattactggctttgctgctttgcttctctgattttcagcttgaacctcaatatctgtctctgggtttttattattcatgttacatctaacgaaccagaattcaatcttaattgtcaaggtaacagctcttatcttttaattccatttattgtttcctgtcagatgcattgagcttgccatttatatatttggcactgaagcctcaatgcaaatatatttattgattaaaataaaatattgataaaatctatttattcatcaaaatctggaaggacaggtggacttctgcactccataaatatggttcctattaaaggagagaagaatagtcaacacattgaaataaacttgcctttgactttgcctctttgagatcacattgtcatttatggtttccctcataatttaccaggataaaatatggaacagtaggaatgggccttatgttaactacaaagggaagctaccacatatttggtttgtcttaatcttctcagcaatttacctattccttctgtatagaaattaattagtgtgttaaactggattatttatgtatccatccttatttaaaatgcttcagttatattttcaaatttttacttatttttgtcttatgcttttacttatcttaatcatgttgacctaataaggacacttttaatgtctcgcacttctttatttccatcacatcatttcaccaagtctggtgtccctgaatcttatatccagggataaccactgtatttatttcctttgagtgctttctcaaaagaaacatttaataaaaggcaggtgaaaacatgaaatgtctgccatgatgtttgactaacataattatttcattatttttctgcctagacacttcgtgtataatgagtaaatttcacaaagcacaaagagacatattgagaatgtgtatttatcctatttccataatccagttgtttgtatgtcctttacaaagataacttctgttatagaattacatgccattgtcttaacttcattataattttctgaaactatttctactatatatctatcatctatcaattatctatcatctatcttaatcatttctctacctttacatctatttatcaatcacctttcatatttgaatcattatctatcttcatcatcatcatcattgtctacctatctgccttcatcatccccatctatctatgatcatcattaatcatctatctctacagctatcatctattttctatcacatatttctcttcctagctatgataatggtttctaggggctggtctcgaactttcttttgttccccttaacactgtgtcttagaagttgttcctcaccaatttatagtgtctatcattaaatgcatatagaatttttgtatagctatactttagatttcctgtttttcctcacttatattgctggtaatattttgcattacaaataatacagcattgaatattcttgtacagctgtcttgtggttttggtactccaaggtataaaatgagaaattacttctacttcattttctcttttcctttcaggttttgctattttaaaaatttccacaaaaggatttattgccttacattcttttctgtaataataattcctacatttctagtttcagatttacatttaaatagttttattcttcaacagaaatctcctgccactgtttatcccttcagccctgggctaggggaagttgattcttaatgcttcttcaaaggtgtggacatgctcccattcaatatttggtttctggtgtgaaatgtcctctatgggctcagagtttgaacacttggcccccaaagttgaggcttaactggaagaaatgggtgtcattggaccattagaggtttgtttttcagtcccatttcctttcctccatttccttccttgatcccagagaaataagccttaggcaaagctcctatgataatgagcaccccatccattatgaaccctgtcccccacaatatgaccccaagccaacctctccttcctttagcttcctctagtcaggtatttcatctcaccaattagtaaggccacatacactgttagttccatgtgttatctctacacttgaacaatgacatgggtggtggtttaattttcagatcatgttctatccatctctttgaagatttaattgctacacttgattttaccattgaacattttggtagaggagactgaagccctgannnnnnnnnnnnnnnnnnnnnnnnnnnnnnnnnnnnnnnnnnnnnnnnnnnnnnnnnntctgataaagaattatttcattatttttggtgtctaacaaatatgtgtgcctttattttatttttaaccatttctttgcttgcttatagaaagaaggagtgaatctttgaaattgtaagtttaaaatcttatttttgttcaaacatgtttgtgaatgttttctatataatgagtgattctttgtcctgcctggtcccgccaccacttcagccccaaataaatatatggatgctatactgattaataaactgttggctaatagctagggcttcttattgctatctctctcttaattattaacacatttctattaatctaagtatttccatgtggtcttatcttacagtagaagggtccggacctcaactcttttggtagtttaaatggggacagttctggtgggccctctctgtctacctttcctagaattctcctcatctcctagttccacctatcttccttcctcattggccaaagagtgttttattcattaaccaataagagaaacatatacacaggaggacaatccccatcaggttctgtatataactcatcacttttgttaaatatttcagctatataaatctggcatatctcttgctattctacatttttaaatctttattattttaattaattgtttaccttttgtgttgttctacaaagttttcatagtagactgctgtcttcaaagtggcgtcttgtgataagtatagtttctattttctattctaaattgtgcctgcttatatttttaaaaaataaaaccaattatttattttatggtatatgtgaatgcctgaatgtgtgtatgagtatcatgtgtacatgagcctgtgggtatcacaagagagtttttcttcctttggaactggagtgctaggtggttttgaaccaccatgtgggtgctgagaattataccaggtcatctggaagagcagtaggcaatcttacatattttcaccactgagatactctttctgtgctgttttttttctggtgaaataaataaaagctctcacctgaggtcagcatattatcgtcagtgtttctaacatagctcaaggcctctgtttgtatagcttatgtgtttgctttacatttcaaaggatcaaaacaaggaggagatgaaaataacaactatagagatagtaggagaaccacaaagactaggatatccacactccagttccttttttttttgaaaatagattcttctcacatacaatacatcccaactgcagtttcccctccctctctattcctctaacccccatccactctccttccatttcccttcagaaaagagcaggcctccaagatacaacaactagcaacctctcccctccctccaaggggagaagagaaggggtgagcagtacatgatggggcagggaggctgagatggggaagaatagaagcgaggaagataggtgatactataatagagggagacattataggtttaaagagaattcagacactagggaaatgtccggaaatctacaacgatgacaccaactagagatctaagcaacagaggagaggctacattaaatgccctcccatgataatgaaaatgatgactaacttatatgtcatcctatagccttcatccagcaggtgatggaagtagaagctgacatccacagctgaacactgaactgcactggaatccagttgcagagaaggaggagtgatgagcaaaggggtccataccaggctggtgaaacccacagaaatagctgatctgaacaagggggagctctcggtccacagactgatagctgagaaaccagcatcggactgatctagaccccataaacgtgggtgtcagtgaggtggcctcagaaatctatgggccccttgtagtagatcagtacttatccataacataggaatggacttttggagcccatcccacatagagggttacaccctaagcctagacacacgggatgggcctatcccaaaggatatgacagactcagaagacaccctatggacgtcctcaccctccctgggagcagaaatggtatgagataggtagggtgttagttgcaggggggaggggggaaggcagggggagggagaggcaactggaattgacatgtaaaacaatcttgtttctaattcaaataaaaactttaaaaataggagagagagaaacaaccaaacacgacaaagaaagatacaataagacaagaccaaagtgctcataaccatacggaacagggcaacccactagaaggtaaagaatctcatgagtaggcaaaagtcatacatgaacccactgttaggagtcagatgggcacttttgtgtcactctccagttctttacaagaaattttttctaacagttatccctacgatgtgttagtgtatttgttaggctttatttatagagcttagtattgcaaagaacctcccacctatttctgtcctgtagttcacttcaggactagtctgcttgcttcaaatatgtatgcatgtggtgtgtgtgtatgtgagcaatgtgtgtatgtatgtgagagtgtgtgtgagtggggtgtgcgtatgtatgtgaaagtgtgtgtgagtggggtgtatgtgtgtatgtgagaatatgtgtgagtggggtgtgtgtgcgttgaaaggagggggaaagagagaggggggagagagagagaacttgcttaattttctactccctccttctaaaggtaatggcaaatttgctcaggaaagtgtcttgctaccagacatgtgccatttcttcaagggagagattgttcattttactcagaagttctggtcttgttttgtagaactggatctgatgttttttctgaagcctgtggttgtggcacaactctgtttacccttcctactctgagttttcactttctttattctcttttgccaattttattcagatactacttgatttacgtttacagatgacttgactcacagatgtcctctagtctaatcctttttctatctatattgttcaaagagaagatgaaaacgctatttcttatgctcaaatacaaaatgcttacttttaataaacatgagtaggtcttaatcttggaatatgttgccagggaacttttagaaatgtagtgaaatgaaatagtaaagatgatagaaatacaaaatgtcatcactaggaatgaactagtaaattctcatgagatagcctcataaatatctaaccagcacacagagtaccgtgattgcactctaagaaaaacccactggagtcctctctgcttggctgatgaaacaccacacaatgatggaagcaactgtaaggataacttcagaactatgtgaaggacttaagtttcccaaaaattgtgaataaagatatttttcagtaatttaacaaatcaccagtatctactctatgaaagggtctatgctaagtggaagctcatttcttagtggaccatttacattctacctactagagacaggtggtatggtttcacctagagatgtaactgacagaaaatgaatccgagttaggaagtaaaaaaaaaaatattccatctatagaaaccctggatttctgaagtaatgaagaccatgcggattaatgagattgtgaaactattacaactattaatttttcattttaggctcttgacatgtagagtgaaaaattaagcgagttagacaagtctatttgaaagtgcaaatgaataaaggatgagattgagttcgaattggagtgttttagttgttcttcacacatattaacctacatagtgaagctaaaattctttaaatttcagattgtggatctgccttgaaatcttgtgggcttagtttaatttcccacatttcgcagttacaacatgtttccaatataattaaaaaattagtttattctgtgttctctctccccttctcattttcatccaggacatgaactattctaaaaatttgcatagtaacatttactctcttttatgctccatgaagaaatataattaaaaaggtgaaagacactaagctgatggctcagaatgcactaattcataatggtgtattaacattctgattaaaagaaaatatctaatgaaaccagaggaaaatctcatgctcacccttttcattatatgtatggcgagttctgagactcaggcaatgttgccgcagaaaggctatcataagtgaatgttgcttaggaagctattcaacgggagttttaaacagctgttccccggcttcattaagactcattatgagttgtcatgtaatagagaacttatattttttgatgatctctgcataccagtgaagataaaagtatgtcttaaggcagaactaaaaagaacagaagttggtacatattaaaaatagattactaaaatgccctagttagttggcacagaccttaaaagcccagtacaatcattcagatttaaagggaaagataaaaagtgactaaactcactgagcttttaatacatcaatggttatattttaggggaaaaaagccctccactcttttatatgagaggtacctagaggcccaaagattgatctgttcatcttctgatagggttcagggagttggcatggccgtggccctgaagggcatcctggtggcttttctaattgttccttgtcttcaagggcaggtggagttacattcgccctctatgtatcaagccccatacaccttcctcctactgcacaaagcaaaaggctatctcagctcttggtcagagcttaaggtcattgacatagctagttctgtatcaacagggatcttcagaattaatacttactgtagaacacactgtgggagtgtgtgtggaggttcagaaatcctgagaaccaagttttgcagctccttttgcacagttggcacactgtttaaaaaaataattttgttaccttagactattatcactaaatctagctagaacttttaatggataccctttttcattgtttgtgaaggataagaaaacatcttaggggcaaaaaagatgtcttagcaattaagagtccttactgattattcagagggttggagtttatttccaacacccaagttttgcagttcaaaactacctgtaactccagatcctactgatctgacactttcttctgaccttcatagtcacacacacacacacacacacacacacacacacacacacacagtgtgtgtgcggggggtgtgtgtgtgaaacctaaaagaaaaatatcaccaatacaatattactattacttttcagttgtgtgatgtatggggaccaggggtgctgacattagcactgccaataactgccattctcatatcaaatgtgaccataacatgctcaacaggataatcttgtgactatctttgcatatatgtctccattgcagatctctttatatcctcattttcaagtacattcactgttgtgtagaactctgtatctcttgaaaaaaattgagaaaatatgaagtgattttcctctttctactgtatcctcatgaaaagaaccaacatgctaggtacattacatatgtgccagttgctgaagatcagattaccataaaattcaagatagcttatagaaagcaccctccatgacagagagctgggtgtgaatgtggtaaaggatgagtgccttgggaggcaacttgtgtaatcctatgaagcagcataactgcagaaggctgaggacaacagctgtgatctaacaaaatagaggaagagtaaaaaaagaaaatatcctaaattatgtaccaaattgtaagaaatgaataatatttcctttatgtatttaaggaggagagatggtattaggtgctgggaagacaggggcagagtccctgagatttgcttgtcagagagtcatgctgattcagttcagagatgaccatctctcaataagatggacagcaagagaggaagctactagacactgttctctggcctctacacaccacacacacacacacaaacacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcacgcatacacacaaacatgttcacatgcaaatgccacacatacacaaacaccattcttctccaatatgtagattaatagaaatgatttagtagaaggatggatccacatgactatgcagggaagtcctttgtaagctggaaaccaataattaagctgcaactcaagactgaaggcctgtataccagtgactgcaatggtttaagtcccagaatagatctgaagtcccaaggaccaggagtactaagttgaaaccttaagggagaacaagatggatgtcccagttcaagagcaaaaatgctcatgttttgtcaccacttgggctgttttggcccttggtggattggatgatgtctacctatacaggtgacagcaattgtcacctcattaactattttagatatcaatgtcttctggagacactttcatgaacacacccaaagctatgcttactagaagtcagggcacctattagtccaatgaagatgacacataattttagtgattgcacccaaatttgcagtaattttgaatctgaaaccttttattctaacctaactattgagttgttgaacattggtctttcacatttgatcgtctttagaccaagatgttgctattactagtaataattgtaaataatttggagacatggagataactagctaatattggttatttatttaatgtttaaggcattattcaggtaggatatgaatttcctattttgacttttcctataaatgcctacagatgattgaagttgccaatggaagcatcattatttaggttttatctaatcccttgcaggaaatccaatgtcctcttttacaacaggtttccaactctgtctatcctctcatcaccaaagaactttagacagttacaaaggaagcttttatagctgttatttcacaatcttgtgaggcacatagggccagagttacaatccacatttaatagatgaggatacaggtcaaaaaggctacatgaattgggcacacaaagtaaccagttagtagaatacctaaggctccaatttaggtgttctaaaatcgaatctagcaagcttgtctgttctgtgagaacatactgccacatacttatctatagagcaagtactaggaagaagttgaactgatttcggtttatctgttttcagttaagatttgtgagttaagatgggactgattatgattatgatccctgaaaatgaagcagacatatctcataaatttctgcagttttttgtttttgtaattactttaaaataattttcattttaaagaagagtactaaacatacaaaccttctaacagtaagggaaagtctgtgactagctcagcatgtgaaaagatgacaggcaatttaattttgctctgcagagtctagttctatcttgtaatggatagtaccaccttagtactatgctgaatttctctgtgtttctaaggatttaacaaagtgtgaatgacctgttctccccatgaaagatgacaagcatgctgtgatgacaataccacacaatcaattttcagaaaggattctctctattccccatgcagctactaaaataagaatggattaaaacagaaagggctcatctatggtaaaatgggactgagatgctagaggtcatggtcttccattaaatacttttgcaataatcatccctaatatcttatacggaaattttgctgctttaaatgaaatgaaatgatttgtctttcttttgtatcatgaccatggtttcactgatgaaagagaaattattttgccttctgattctattcaatgttatttctctgcatgacaagtctatcttttatttccaatgcaattcaaacttacattttgataatcattgaggtcaaaaagaaaaggtatgagatgcatattatttgaatatagtctatcataggccattcattgaaatatgtctcttttcctctctgtatcaaaggcatggtttgtcacctgtgttttcactgtagtatattgtaagcattacatagtatattaattttaagtttgagtatcacagtgggtgaatttagtcttaaaatcataggtcatttcagactttagcaagagtgtatgtattctacggaacaatgcatttatactctaaagagactaagcaggaggaatgatattgtggaaagactaaaatggtttcctacaacacaccttggcaaaccaattgttccatagattctgagtacttttccttttttattatttcttttatttttttagattatatcattcccctctttcttttccaccttctaaacacccaaaacctagccatgctctttcaaactcatggctttctttttcattatgttactcacatgtagatgttttaggatgaccatttggttttagataactaatttgtgtgatcttccctggggaagattatttctctcaacattccttagtttcttgtgtttctttatgtaggattgaagccttgtagtttttgccccattcaccttgtcatgtgtattattgtccttgtttagtttctgttcatgagacttaagtgatgctacttctgacagtcctatgagacataatctcacagcaaactccctgatcttctatctcttaccacctttctgcctcctcttctgcagtgttttctgagctttagatgtagctatagatgtatctattgggactgggctccctaaccctgcattttgattggctatggttttccctagtagtctcagtttaaagcaaaaaaacaattacttaatgactggtaacactatgtgtaaatattcaaacatagtttaattaaaattttctcatttggcttggcagtgctctctttaagagtcaaagttcatctaacaaaacccttgataccagacatgggaagccctcttttgagtttttggttagtacagttgtcatagacatacttaagattttgagaaaattactattgctcttgattatcccacagaggtgtaaggtaagtctccattgctgaagacatcatgaaccagacgcagaggctcctgagctggaactggcatgggtgcctcctcccccaaggtctaattttcatggtaccagaaggcaccatgaaagtttccaaaggtgggaagcagtcaacagccctactcagctatgatgcctatgaactgaaacaatgaccaacatggcataataaccctaagtgtgcactaatggcacacattccttgacagcagctaacagctctctaatttgacttaaggcccactcaaaaatagggaaaccatgtctcatattagaaacctagccaactacctaagactagtgaagtcttggagcagagcttgcaacaaaccaccattttactaaaccagcataattgcaaaccacattctaaataattgtccttctatccacagataggataggtacttttgtttaattctgtctaacttatcattttcatattcattttattcaatcacaaatattcatgatgtttccaatacaggtaaggcattctttttttcctctccattttttatttcaattagaaacaagattgttttacatgtcaatcccagttccctctccctctcctcctcccctacccccaatgaccccctatcccaaaccctttctgttccccagagatgatgaggtcttccatctgggggggtcttcaaagtatgtcatgtcatttaaagagaattttggcactagggaaatgtccagagatctacaaggttgaacccaactaacaatctaagcaatagttgagaggctacctcaaatgccttcccctgataatgagattgatgactatcttatatgccatcctagagcctttatccagcagctgatggaattagaggcagacagccatagctaaacactggtctgacctggaatacagttgcagagaaggaggagtgatgagcaatggggacaagaccaggctggtgaaacccacagaaacaagcattcttttttaattatagaaatattataaagagaaacacaaacattttgtaaaaaaaattttcactgtgcaattatgcgtcagacaattaactaattaaataatgttctgccatctcctgcaaattgtggtttattaaatatatggaattgaaagaatgggtagggggaatggaaatggagtatgtttatttgaccttggaagctacattgtgctcacatttgaagtcctcatacacctatcattccacagaaaacacaatgggctcaagagaattccatgctctgccaacctggggctgctttgcatgcatccttgactcacgctttgtatttcttcacagtttatttattttgctaatacccccatttcaattgtattttttctaatttaactaccaatatctgcaatgtgtgaactcatagctttataacactttaattttttaaaaataactttatcctctgaaagattgagacagctaaccaaacttagaataataaccactagatgtcggtgttaccactggatctcagagatgatcttagacctcagcaaacttgcttgacctagatatttcttagcacaaatagatactaaaaatcttcctaatcttttgagatgcatcttgataaattttacaagtattttctaaatgataaagacaaacatctatctatcatctatctatatctatctatctatctgtcagtcatttatgatctatcacattcgttaaaaaattttatgaaagataagaatataagcttatttacctattcaccaagttaaaattcatctatcattggtaatgtagctcaagtggtagagtattttgttttgctgcattaacccctgagttcagttgccagaaattcataatccagatatggtgctgtacacttgttatgccagcactcaagtacaataacaaacaaaaccacaacccccaccaaagaaacaaaataaataaataagtttgtctcatcctatattttacagcatttacttaatattgtttaataaactcaagaaacatctgttgaacattatgatgttctccatgaggcaccaagaaggtgaatttagtaagttattatccctcaaaataaaagtagctaatagtacactgcagtgaggacaatgcaaggatgattaatacttaatacaaggaagattaatgcttaatgcatgggagtggtggcatctgaaatagaagagtaacataagcagatctgtagacaattgagagatgactgagaggcctgagctgcaggatgacaagaatggagccaggaaggacttatgcaagatgttaaaggcttataccaagtatgtatagaaaaataaagggcaaattatagaaaaattaagacattagttaaccactctttcagtttcccccatgaaatctacgaagctgtgtgtgtggtgatccattgccctttcctctgaactgaatatagcaaagacactttttatctcatgcagtcttatgtttgttgtagcaattagtgtttttttttattccccagcatctgggcacaggatattctgaactctcaacatcttcttccttagcttttcctggacagaattcatttgtactttattgtctccattcacaaagtcacaaactcacctagctgtgatccaccaatcactggacttcctccactcccaaactcttccaactgccaaggactgaatgcacggtatttgttaatcatatcctactggtggcagtctaactctatgcattagatgcacctaccaccattcataagaaaacatcatagtaccaaatataagggtgcctttatttcaatgtcatcacatttgtctcttttgaaaatcacccaccagctgaaaatccaccttcacacattttctgtggtttttttttcttactttttattaatacctgtcagttaaaacaaaatctcttctcaggcatccttcaatttgagtcttctccattcttatgttctgggttttccaaaactaatgataatctactgttgagggcatccttttttaaaaaaataatttttattgaaaataaagtttttcatacagtatatttcttttttttataatttttcctattcatttatttagcacataaataaagtcatgcacaattgtgatacacaatacagtatgttcacaatggcatggctaaattaaaccaattaacatgttatatcacacatattcatcatttttgttttgagaacacttaaagtatactatctcacaactttcaaaatatagcatattgttgtcaaccatatttatcatgatctcagtagacctcaagactcagagagtccatgcctccccatgccagctacactaaagtcaattcttatttgtttctatactaggtcctccaaatccaatgttataaacacctttacataatgtttatcctttttatttaatttttttcattttacatacaactctagtttcccctccttacacttctccagcctttccccactccctgatcctatacccatacgttcctcagagggtgtaaggcctcccttggggagtcaaaaaatctggcataccaaattgagacaggaccaaacccctccatactgtatcattaatacatactatctttcctggtgctcaagttagaaggtttggcaagatctttaatactttccccttttacaattgtattcaacatgtactgttaaacttgtgtttcagcatctattgataggtgccagatgcttagaatatggaagttaaccaaatttggttgaagtttgagatggaagaagacagcaaagactgtaagtcattttcagcatgctatgatgatgctttgaaagataagctgtgaaagttgtagtgaggacttgacatagactgaattttcagggaatggaaagtaaaacctgaaggacagtaatgaatcagttatgtgaaaactgggaaatgagtacgtcagagagaatgggcaaccagggtagaagcactgagatagaagagtttgtcagaggtctatataaaagtagagttttacagaggtctatattaaagcagaaagctgtctgcctctgctaaaacatagtgctgctctttaacgctccatcccttacctcctggctccatctctatttctaggccttctttggtttttttttttttaattgaatgtcctttgtttccatgatgctgaaaacctctataatttggccccttaagttgttcttttccttagatatagggaaggactctacactcatctcattgctggtacttcagattcacctctctggccttccaaggatgccttaattgaatggaggttgaattcttgcttcctgataaggaacagtgacatctaatccctgtacttctctttcgtgactaatggaactttgtcttatttcctttattttctttgtctttatcccatgacaaactgtagacttggtaaggacagtaataatatctgtattcttttagctctgtcttcagtgtgagcactatcctgtttgttcagaatcttccaataagacctggatgaatgacagcatgagtggataaaatgaattcatcctcattgtagaaagagagccaaatatgggcattatggccagctaaacccccatctgttcaccatgttcacaaaacaattcatgtgagaaagtctggttaaatcaattggggaagttctggatttatgttagaggaaaacaatcctcatctgtagtatttcacattaaaattcaatataaaataaatccccataactcttcctctttcaagtctagtctcatctctgatttttttctgatagacaatcttgatatagttggtgataattttccacttctatctgctctatagaccactcagtgaactggagtgaaacaactctttgtgtgtacaatacaatgtactgttgcagccttagtagtctgtatatcagacaacattgttactatccagaattcttctttggggaggtactttctttgacttcttagctcatttcatactaccctactttttattcctctgttgtattaactttagcttagcttagctttctaaatgtaaagagttagggagacatgggcctcagtcctaacctcatccttctctgtatttttttatttaatattaaggctttagaaagtacctatccattaggacagtggttctcaacctttctactgctgcaacattttaatgcagttcctcatgttgtggtgacccccaaccataaaattatttcatggttacttcgcaaatctaattttgctactgttatgaataatagtgtaaatatctgatctgtgacttcaaaggggtcaagaaccacatgttgagaaatactgctttaggatgttccagttttgtacttgtagccatatcttagtcctaaagtccagatttttctgttcaattttcgactggacatctgcacttatatgctaattagacatctcaaaactaacacatcaaaaattgaacttttgaatttcctcacaaaatctgcttctccagaagtctttctcttctcagtaaatgcaattccttctgccaattgttcaacccaaacatctcagagtctttctttattcctcccttgctttcgcatcctgcttggcatctattccagtcctaagcacttctcctgtgaaggaagtttagaactcaggaatcccttcacacctgaactctggcacagtaaactcactggtccccctgatcccatgctgccagagttgtcacttactagcatatgtcaggttgtgttattcctgtatccgatctttctctgtcctcactgtggctctggatccatgtcaccttcctgagctttcctttcccacctactgtaaagtacttcctgtcttaggaaaggtaccaagccagtctgtttttttttttttttaatactccaagaaggctcccatttccagtactttccatagttcactccttcccctccccatggtgattttttttccccagcagattcaagcatgtcttactccttgctaaaactctgtgtttagaatttgcatttttctgagagtcctctttcatacttctttaaaaacagtcttataatttctactgttcatacttctttacttgtttctctcctttaggagtagatggacaagtgaattcaatatccatcctaagtaggagtagaactcaattaatctggccctaatttaaagcacccacttgattttctactgtttgtttcaaacaaagcagaaaactggaagcttctaagcatgctcacagtctttcagaccactcaatgccttctgatgaactggttgtgcaaaagaactcatgcttttgttttggctaaagatcaaaaactttctgtattttctcgtgttctcctccaatggtttgcaataattactcagacttacactgagctaatgggcacttcttctttctctttcagctcaggactttctctaagatttgtgtatagctgtaggcatattgggaacacagtcttgttttttatagaaaagaattgtaaaagattttaccttgctccttaacattatagaattttcaaaaaaaaaaaaaacacaatgtagcaaaaattgtttatgaagaattttttttctttttattaaattttattttatttttattttaattagaaacaagattgtcttacatgtcaatccaagttccctctccctaacctcctcccctgccaccccccaactaaagccctacctatcacataccatttctggtcccagggagaatgaagttttctatgggggttttcacagtctatcatatcctttgggataaggcctaggccaacccccatgtgtcctggctcagggagtatccctctatgtggaatgggctcccaaagtccagatctatgttagggataagtattgatctactacaagaggccccatggatttccgaggtctcctcactgacacccacattcatggggtctagatcagtcccatgctggtatcccagctatcagtctggggacaaagagctccccattgttcaggtcagctgtttctgtgggtttcaccaaccttgtctggaccactttgctcatcactcctccttctctgcaactcgattccagttcagttcagtgtttagctgtgggtgtttgtttctacttccaccagctgctggatgaaggctatatggtggcatataagtcagtcatcaatctcattatcaggggagggcatttaaggtagcctctcagctgttgcttagattggtagttggtgtcatctttgtagatttccagacctttccctagtgcctgatttctctttaaacctataatgtctctctctattatggtatctattatcttgatctcctctattcttgcccagactcaaccttcctgatccttcatatccttctcacccctccttttctccccttctcattctcctagctccctttcccctctccccggcgcccaatttgctaaggagatcttgtcccattccccttctccaggggactatgtatttctctcttagagtcctccttgttacctagcttctctggcagtgtgaattttaggctggtattcctttgctctttgtctaaaatccatatatgattggtacataccatgtttgtctttttgtgtctgtgttacctcactcaatatggtttcttctagttccatccatttgcctgcaaatttcaagattccattgttttttttccctttgagtagtactccattgtgtaaatgtagcacattttcatcatccattcttcaattgagggccatctaggttgcttccaggttctggctattacaaatagtgctgctatggacatggttgaacagacgtccttgttgtatgaatgtgcatattttgggtttatgcttaagagtagaattgctggatcttgtggtagactgattcccattttcctgagggattgccatactgatttccaaagtggctgtactagttggcatttccaccaggagtggaggagtgtccccctttctccacatcctctccagcataaactgtcattggtgtttttgattttagccattctgacaggagtaagatggtatctcagagttgttttgatttgcatttccctaatggctaaggatgttgaacactttcttatgtgtctttcagtcattttatattcctctactgaaaattgtctattgagttctgtgccccattttttaattggattgttaggtgttttggagactaacttcttgagttctttttatattttggagatcagccctatgtcagattggggttggggaatacattttcccagtctgtgggctgccgttttgtgaagaattctatcatcatttctcactacccctttcaaccatgtaccagctggtgcactttgggtgaatggctggttaatggctcagttcccagggagaaggaaatgaatgaaaatctaagcaactttttctgttttgtttttaaatgcaattaaattccatttaggaagatattctgctccatttaaaactgtttttctgggcctacatttgtgtctcatgttttgtgtgcatgtcaaaaaataaatgtgttgaattaaagaggtgactaaatgaatatgcacaatatcagtttctggaagaagcctcggacactgtactaataacttcattttcaccttcatcagggtaagcatgttacagcctctgtgatttcctcagtaaaatggaggcaatcctacctcagaagccagctcagcaaatttggtgaaataatgtcagctttgtcacacatcaggtcctggataaatttgggtgtcctttcaggttccatgataacattcctccatttctactgttggtcattatattaatatggttcattctggataagtaatcttcagaatagtgtatcattttgtcactaatcttcttcttttgctcctgggatcacaatacctgattgttgttgctttgattattaaacatgcaactacaggcaacagcaacaagaaccaaaacagaacctgatctaacaaacgttctgtagctcatgtatcaatatagtttgttaaatttccaacatccctatctgtgatggaatgtgatgaagacactgcccacgggatacttcaggttccttgggaaagctaactttattgacatattcccgactttcttaatttgaaaggcattctttgcttcttaaatccacttctagggaataactgttttaaatttgatcaaagtaaaaaaaggaatccttaaaaataattatgtggcaatattttttaaaaagtaccattttaaatgaagtacattgggactgaaaatgcaattggatgggaatgattattttcttatattgtttccttggttattttcaggttttgttgatctcagctccaatggcctctcagcatgtgtaccctttcctgggctgggggtggctgtctttgttgtatttagatatttagcagcattgttcacttcttacctgtcagatgtcagtagcagtcctccagaaatgtcttcagacattgtcagctatcctgtaggcatgttgataaagggaataagtagttatcaactaatatgggttattctacctctggctggagtgcagagatgttctctgttaagtggtcatcctccagtgagaaaaactactcagcttaaaccagactcttagaatccatctaaggtgctgccaatttctctcacttcttttgctgggtgacagacaactcagcagtgatagtgtaggatgaccgagactgcagtttctctaacaggaagagtgcacagttgacattccaggataattatgagcaatgttcattttcttcttcaattgtgtgcacaatcaacttagtctatgtagtgaacactattctagaccctgagtcaagtgagtaaagtgacaaatatacaatacatgtgtgatatctacccctcaccctctgaaatacaggcttccatgatgatataggaaataaataccataagagctggtgacaagtgtgattatgcaaagaaagttaccacagagtgctgggatgggttggattgatgtgaaggcctctttgagggcacacgagactgaaatcacacccatctactctctctctctctctctctctctctctcactcacacacacacacacacacactcacacacacacacacacacactcacacacacacacacacacactcacacacacacacacaccatctggtattttaatactttgtccccagctcatgatgctgttttcgggcactgtagagcctttgtgacatggtacccacagaggttgatctctagggaaagggcttgactattccaactgcctctgatactggtctgcagtatccatttcttaaccattgtgatgtggaaaaggacctccctctggtgccttctctgatggacagcctttgagagtgtcagtcaaaatacagctaccctcccttgaattgggggtctcattgggtctctttcctcagagcttgaagagggtgaaggaagaatgtaggaatcagaagggatggagggtgccagaaaaacatggccactgaatcagataagcagggctcacatgttctcagagagactgaaatggcaagcaatggacctgcatgggtctgcacaaggttctctgcttatatgttacagctgttagattggtgctttctttttctttttctttttctttttctttttctttttctttttctctttctctttctctttctctttctctttctttttctttttctttttctttttctttttctttttctttttctttttctttttctttttctttttctttttctttttctttttctttttctttttctttttctttttctttttctttttctttttctttttctttttctttttctttccagacgaggtttctctgtgtagctctggctgtcctggaaaactctatgtagatcaggctgacctctaagtcagagatctatctgcctctgtctcccaagtgctggaaatgaaagtgtgtgtcattactgctgggctagtttggtgttttgacttgctcatgggactctttttcttctattaggttgccttgtccagccttgatatgaggccttttgtcttgtcttattgtatattgttttgtagtgtttccttgttgtctcttggaagtttgcttttttctgaagggagacagagggggtatggatataggggagggaggtagggaagaattgaaggagtggaggagggagggcaaactgtggtcctggtgtattgtatgagagaggaatctattttcaaaacaaacaaagaaacaaacaaacaaataaaagatacttctcccaggtatttcattcagtgatgataaatgactgatgtaaatggaggtcaaaggctgcatcaaagaggtgtgcttctggatcttgttattctacattcaaacagaaagaatcaaacttttagcctttttatttatacatcaggcctgtgaatctcctatgcaaacttgttttcttcgtgttgttcttttatgaatattccttaataagcaaaagctgaaactagtctgtactattccacacatacataaactcatacaaggggagttgtacatgagaatggttttgtactttgctctttttggtcttctctgttcttctgtcagcaaatgtagaatgactgctttcccttttgataatataaatgattgcaacatttttccctttctttttcctccctccaaaccttctcaatacccctcactactctcctacaaactcatagcctcctttttgttaattgctattacatatacatatgtattcctaaatataaattacttagttcatgtactattactagtatgtacattttcagagctgactatatggcacaggaaaaccaatttgtacactcttccctggagaagataatttctcccactccaagcttttcttacttgcctctagtcctttgtactgggttcaggggaccttgaggaagtggaggggcagattataagagtgtaagacccagaagatcaagagtttgctgtgaaatgatgtttcctattaatgtcagaaaagctgattttataaaataataatttttatttataatttgaaaatttcatagatgtatatgatgtaccttgctcatatccacacctactctacccttcctttgccccccagcccatgctaacacatcttccaaatcctctttctcctccatctctgcttctctgcaaccgtgccagcactgaattatgggtcagcaattggacatcattttgccccagagcccacaaaggaagaattgaggattaggtagttttaaaagtactgtccatgtttctaatgaaagccagcaggtaattagcctgaaaagcattctaaccaagtggcatgggcaattaagactgtcctgtgaaaggaaaggatgcctcctgcgataaggaaagtggtctgtgcagtttttgtcagggtttctgaagctctttgttctttctcttaaaccccatagcttcaaacccaggtcttatttgaaatctgtcagctgaggttttagccataacactagtcttatcttttcaaaagggttggatcaaagtagcttagttttcatctgagtttaacagggaaaatgccccatggctgtcactctgtaatgagtgctttcccaggtgaccaatactaaaggactgcagggatattctgcctttgtgtttgctgtcaccatcagaccttcattcatatgtatgtatgtacatacgtatgtgtgtatggagcagtctttatagaaggaatatacgagctatgattcagcttaccattaacctgtgaagagagctaaatgagagttaagtacttctttaaactaggtcaaaatcaaggcgagcgactcatagcattatacccttagacatcaaactctgttccaaagaagtggtatagaaattgatcacccatgttttgtatagaagctaagctaggaaaggactggagtttgaatccctataaccgaggtatgctggatgcagcagtgtgcatctataattccaaggcttctacctccacggggctgggagtgaagcatggaaaattccttaaagctcctgggcatggcctggtatgttcatcaataaagtggaaggccaagaccaacccttatagttgtcctctgatatccacatacaccttggaaatatgagccaacacacacacacacacacacacacacacacacacacacacaatatacagctgaaaatacattttgcaatttttaatatttattagacagattcgttgtatgccacttttgttgcaattaaaaactgatttttttactctaaaattatctatggataaataatatgaactagatatgtggcaaagtggagtattctgggttattcaaagaattgaattctgagcaactggaattgtgaaacctgctctaagggttgagtggtcctacatgctaaaattcagtgtcctgattttagtcttgggagtcttgctattagaaacccaagtggaaatgttaagtggagaatcagatatgaaaatctaggatttgaaacacagctgaactctggaatccagttgcagagagggaggagtgatgagcaaagggatccagaccaggctggagaaacccatagaaaaagctgagctgaacaagaggttgctcatggaccccagactgacagctgggaaaccagcataggactgttctagatgcccttaatgaagatgtcagtttggaggtctggttaatctatggggcttctggtaggggatcagtatttatccttagtacatgaatggactttggagcccaatccacatagagggatactctctcagcctagacacactgctccaaatgatatgacagactttgaaggtccccaatggaaggcctcaccctatctggggaacagaaagggcatggaatatgaggtgggtagggggcaggggaggaaggcagggatagggaactgggattggcatttaaaagaagcttgtttctaatttaaattttaaaaaggggggaaagaaagagtttaaatccaaaggaataaatccaggagccatttgcttgtaggtgatattcagaatcataaactgaatgaattagatcataacctcattgaatttgaaaagagaagagatcgggaaagtgaaaaaaaagcaaaaccaagaggctgtgcaaatctagatcatctgtgtgggtctgtgttagaaaggaaagcaagttgataacattgcatcctgaggtaggacagacagatagtcaggggaagactggggggtgagtatggtcaaacattgaatttacgcaaacatattttaaagatatctgcattatctcctttgtaggataactccaaccaaaatatgtatttatgtatgtatgtatgtatgtatgtatgtatgtatgtatctatctatctatctatctatctatgtatctatctatgcattgtgtgtatggagattataagaactgtacattcccatatggcctttctaaatatccttagtgcttgttatccctccctgaccacctcctctgtccaaccctaccattcttcttctcatctcattccttctcttctattctcctttgtccctacatatgattttataaacttttaagtctcaaaacataaagttacaaccatctttaacatcatgatatatgaattagaggtataaaggtagaaaatcctgtccttatttggttagggaaagggattaagggttagggataggttagttggagtttctttttcactccttacacaggaagagctggaaagtgatgctactctgttgcttgtgttagtgtggtgccatgcagagctgaaacatgagtatgtctacatttgactctctttaacaaaacaaaatggctatttcatgtggtttagtctaatatatacaatatgtatatatgcagttatgcacacttgtcattacagcaaggttgctcaaataagaataaataaaacaggcacaagatcttttttgttactccctgaaatctgcactttatgactatctcttttctagagaaaaatcaaggcagagcaagtgagtggtggctgaatttatactgtcctgtgtacattcacacctaagtctttattaaaaactagaagtggatgatgttttgaatattttgattatacaataatgcatgcacacatctctttgcaaaacattgaagacaatataaaagtgtacaaagaagaatataagttaccttcatgtctttatgtgttcatgtatgtgtagtgtcaacaggtgtgtgttagagtgcccatgagtgcacatgtgaaggatttttggtatcttcctctatcacttcccaccttgtttcctgaagaaaggtctctcactgaaccagaagcttgctgtttctgctaggctggctgtccaacaacctcatgaattctggatatctgtcattagtacttggattacaggcatacatagctatttccagctttatatgtgagtgctggaaattcagcctcatcaacatttgtagcttaacttcattcaaattactacattgtgttcaataatattactgtgttatgatttatccaatgcctgtctgattttgaatttacattattagattcaagtgataataataataactgtatttcaaggaacaggcagagagtcgaatatatatttatgagagtacttggctaactaacatttaataatgccaggcttgcttttaaacccaaatctgatgtgtataaattatgggaagtttctcttatttactgtgttagtcaggcttttcatcatggtgacaaattcctcaggaaaatgacttaggaagagaagagatttagtttggttcagtttcataggttatagcttatggtcagcttcatccatcatttctgtgactggtaaggcagaataccctgacacatagatgaacaaaacaattgagtagctcttggcaagcaagaatagggagaaagacagagggatacccaggacaagatacaacctcaaggatacatggtccagtgacccaatttctccaagtcagccccactctcccatacttcccataaccttctaaacaggccacaaagttatgaactcatcagtggattaagccattgattaggtcagattcctcagggctgaatcaactctcagtgactgtaacaaacagctggagacccaggcttcaaacaaatgagcctttgaagtttactttatatagagaccctaacattttctcttcctgatttataatgatatttaactattcatgtgtcttccattttgttttatttatctagcttccaggatgtattttttcctttaaatcagaaacaagattgttttacatgtcaatcccagctccctctccctcttctctttgaaggtccccaatggaaggcctcaccctatctggggaacagaaaggagatcggaagagggaggatgaggtcttccatgggggatcttcacattatatcatatcatttaaagagaattctggcactagggagatgtccagagatctacaaggttgaacccaactatcaatctaagcaacagtccacagtcagggctcaaatgccctttttgataatgagattgatgagtaacttatatgctaccctagagccttcatccagtagctgatagaagcagaaacatagacacacagctaaacattgagctgaactctggaatctagttgcagagatggaggaatgatgagcaaagggatcaagaccaggctggagaaacccacagaaacagctgactggagcaaggaggagctcatggacccctgactgatagctgggaaaccagcacaggacttctccagatcccctgaatgaggaggtcagtttggaggtctggacaatctatgggaccactggtattggatcagtatttacccttagtacacaaatgggctttgggagccctttccacatagagggatactctctcagcctagacacactggggagggtcaggatgtatcttttataactcatattgtttggttttgaaaattatacactctgtagatatttttttctttctaacacatatctttaaaaatgtttcagatataatatatttttatcatataccttcttccccctactgctcccnnnnnnnnnnnnnnnnnnnnnnnnnnnnnnnnnncacctaacttcatgactttcttatgttctttctctcttaaaaataaaataacaaacagagccatagattaacataaacaagtaagagaaaaataccaagatgaaacaaaacaaaatcacctgtgtgcatgtgttacacacacacacacacacacacacacacacacacacacacacacacacacacgggggggagagagaggaatccattgtaagttggtcaattactcatgggcaagagggctgccctggtgtatggttggtatacctagcagcactccattggaggaaatgattttccttttcctagaaatcatcaattgcaaatagcttcttggttagggtgagacttaaggctctcctcagtttctcagggctaagctattgtctgttttgaacttgtagtagtagtgtcttgtggactgtgctgtcacagtttttgtgagtttttatgtggctatgtaaattattgtgtccaagaatctaaccaagaatctatttgtaattgatacctggtgggaaagagaaaatcaattttctccaatggagtgacactggatatatcaaccacctgcagagaggcctcatgcccaggagtggttggtcaacacaaaattgtctccatagctgttttggtgtgcttttaatatttttattgtgtttacctgtcttttgttgatttgcttggattttttgttcttttgttgttttgttttgatcttttgatattttttaaaaacttttgacagggtatggaaggaaggagagagggagacatacatacatatacacacaggaaagagagagagagagagagagagagagagagagagagagagagagagagagagagagaatatgtgattgagtcctgtatcctgagtgacttatgtaagtggtaaaatttgattgaatgaattgagggcttgttggaatatcccctcaaaacaaaggcaaatccttgtattgtgtacttctcaacctttagagaaattaacagtgcacatcttgcattcttgggattattcagagttttgggcgtagtgaataccatacgtgggattattctctctaattatttgactatatttccagcttttactaaggtctggccaaagagagaattcttcctgagagctatgatatttttctaactgtcctgccacttaaaatagttgacactgtagctgcagtggtgctatgtgtgagaaacattaaccagagagctgttacatatttccctaagcagcaaaggaaagctgatgacttcagtagaacaattcacagtttgaaaagccactactgaaagactattgagcctttgaagtgactgtcatataccaatacacaaagcagccatttgttgggaattacctgatgagagaaagtttgtcaggtcaacaatcataaagtcagaaagacacacaggaatttgctggatgtatgaagtaatttattagggattgcattcaaacaatttcacaggacaagtgtatcatgaatttgctaatggcagctcataaaacattttcatatatatatttacaggtagtatatattagtatgaatacagtatattagtatgaatcaactatggaattatgaccaatgcctaactcaaaagtagctttataagtaatctatgagatgaaactacttcattaggcaggactgtgaggaacatagcttcatttctctcatatggaggaaaaagtatataatagtaaatgtatgtctttatggattcctggataacagtagtatggcttgacttatttgtcaagaatatgtaagctatattaattcctttgattctttgttaagtttctgtctggtgtttctgtctagtggtgagagtggggtgttgaagtctcccactataagtgtgtgaggttttatgtgtgatttgagtttaagtaatatttcttttatgaatgtgggtgtctttgtatttggggcatagatattcagaattaagacttcatcttgatggatttttcctctgatgcatatgaaatgaccttcttcatgttttttgattgattttagtttgaagcctaatttgttagatattcagattgctgcaccaggctgtttcttgagtccagactgacagcttgggtgtcagttaggtagcctgggaagtctatgtggcccccggtaatggaacagcatttatgcctagtatacaaatggacattgggagcccattccccatagggggatactctctcagcctagcatacgggggactgcctaggccctgccccaaatgatgtgacagattttgtgattccctcatagaaggcctcactgattctatgacgcagaagagggatgcgatggagctcagtggggcacatgggaaggagagggcactgggattgttatataaaataaaattgtttctaatttaagtcaaaaaaggaaaaaaatgtaagctatgatcggcatgccaaatgtcatctaccacctatttttatatggtctctgaggtgaaaatgaaatttttaaaatgcaaggaaaatgtttttaagaatattatttcatagtatggggaaaaactttaaatttgggtgtccacaaaatgttcttattaaaaattactatgcacattttatgtaatctttctcttcttgagtaataatgtggaaattaagtggtcacaaaagagactatgtatttaatgagaaactaattaattttgtgattcaggaatttcatagtattgtattctgattactttctccctaactgctatctcttcccatcaccatcaacagtccctcatctccatcagttggttttgttttgtgacccatttattctgccaaggcaatgtatatgagggttggattggaactatctcttggagcttctggagtcagcagtgggtacacaacagaatcaatgatcctctccttccccgagtctaccagcaaagaacagtttaccgcaagggacaatgttgcttatctactttgaaatccatctgttttctaaatatttatgtttatgccttaatttttacaatgaatgtgggtaaacgcagaaacttagctgtgcaaagtgagaaaaagtgatggatggatggatggatggatggatggattgatggatggtatattatcccaagactctgagaacactatagaagagggtccagatataatgtaagagctgtaagatatggaaaggagctatgaaatatcatcttctgggaaagacacaggactgctttcaagaactcatggtagatacagattcctgtcctggatccctggatctgcattagcataggccaaacaatccagtgtggatggatggaagatgggttcagtgtctacatctctcagtgttgaactatgtggccctttttatgaaaagtttatagacttcctagataagagcttagaagaattaattggctattataggcaaaatgtcttttaaaaagtcattgaaatggattttcaggagtaggtagagattcttctttaagtgtcaggagaatgtctgatgagaagtcactgcagaagatgtttgaacaagtgtgcagggtgagcccatctaatagctgtcaccagatctgcatctagcccatgctttccttcaggaccagaaactgaagaggtacatgtgctggtaaataaaatacctgtgatgatcaagtaaagaaggaagaattcattttcacacacagtttggagtaacctcatggtggttgagaaacagaggagacagaatcaatatccactccaagggtatgattgtaatggtccaacctccttctactaggtactatcttctaaccattagtgcatggacttttagggaacatctacaatccaaaatgtgatataaaggttgtgcttatagaggatgcttagatataatagcagctcacagttcatgatcaagattttttctgttccctctcttggttcctggggtgtgtggagcagatgttatctaccagaaaaccattgctttcttaaactgatattttatcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaataactgtgttttaaggatatagttatatattactcatgtagcaagaactctttccttattttctgttatttttacacatgacaaagcaaatatattgatcatttcttcattaagcacaaataaaccccacaaaggatcaaggaaatcttcagtccagctgtagatcaatcctgtttgggaagactgagtttaagcatgggaacaggaatttcaaaccagataataaatttggggaagagccaggagtcagagaaagaccagaatcatgtccatgacacagagaaagagtcagcactagtcagagacaaggaccaataatttaagtcaagacccagggatgctgaatgtactttttcttttctggagtgttcactttggaagaaagttatgtgattatcagttatcaaaaatgtgctagctggatgcagatgtatgctggaatggtgacaagggtaccctgcaagagggaaaagaatgtttctcaaaggctccatattgcttcctctctgtatgggattctggggttgcccctgagcactagccatcctagggtctataggcaaaccatgcatggaggctttctattttctgtttgcatagatgtgaagagtacatagagaaaggcagcctagcattaccattgaatgctaagcagagcataattgactgttgataataagtaaagtggaaactctctaaattgacttcttatcactgttaattatcattctaagtaaaaaggtgaaataattcttgaccttcccatacagatatggatttttctttgagaggagactagcataagttctaatcaacttcacttttttcctataaaattaggtaatgtccatcaattctcagctcaatatataactcatgagttcatagttatacatatgagctaaagaaaatatttagaaaattcctattgtcatatattaccagtttaacttggagattttctttttaaaagctagcaacatatttatattataaccaaaaaggctggcagagctgggtcacattaattggtgaggagaaaattatacaacggaatggagaaataaaatagcaacagatgtgctaattaaggtaatctaaatacatataaataaacatggaataaaatacatataaataaatatggaataaagtatcacagtcaaaaagacatcacagtcaaaataattttaagacagtgatatatgcctcattaaaaatgagagcagagaattgcttgttaccctcaacagaataaaatgtactgtgtttatgtgtgtgtgtccttataatcaataaggaactaccatatttgagcaggtgccttactaagctttatgagcatgtgaatagtaaaggtgtttatattctgtgttaacatgatacaactgcaatgaaaagaaaaagtctaagtggggaaaataatgtttcaggtcatactgatgaagtgagttataaataagattttttttaatgaataaaaactctgatattacacagtggtaaaattagagccacaagtgaatgagaataaaattctaggaaaaatgtatgccatttccacattaacattgaaaatccccagtaactctgaggttataaggatctatgaccagtcatggtttactggttactttaaagctttgaataaaaggcattatttatacatcaaatacattatatcaaataagcatccagttgtcagaggagaaaaagagaatttatggtcagttgtaacaaagtaggtcctaaaattgaccactaatatttcactatttattttttatttatttatctatccatttatttatttttggcctacttgagaaaaatctttgagccttatattaagggtagaaattttggttcttttataagtaagcattaaattattcctgtgagttagctcagaagttaggccctgacaacctgagctcagtctcctcctgagaactcacatgatggaaagagaagactgaaccttataagttgttctctgacttccactcatgtaccagggcatataggacccccccaaaacaaataaatatgtatataaatgcttacaaaaacagccagaaacaaatttattaaacacttttaagtttggtagttatagcaaagactccattcttactgaaaagataaaattggatgataagcttctatgaaaaattatcatttatgtgagagtcagcatcacaatgattatggatgggaaccaacatttcctattctgaccaaatgacataacataattggtcttgcaatttacttctacaagaatttattgacaggaaagatagtcaagacacctttcttttctgttaaggcattatatagtttgttctcacttagtatagacatgacaagtctttgctgtttttcagttgagtctacttttgttgaagttccttcagcactcaaaggatgctgttcggcagaagattttacagactgaaagaaaaccatgaggcaaactattcaaagggtttatttaagggactttatgttttctgatggacaatcacctactgcccttgagggtaccaggaagagtgtcctatcttctggaatggaacagccatcctgctatttaacatcagtaggtagttatcattcaaaggtgcaccttcactggcataattttctgacagcctgcatctttttagactaagtatcagcttcaactacagaaacatttccagtgcacagaatctgcaaattataatggcagataaatgtggaaaattatgaatacttaaatgaagacagtgaataatcaaaaacacaatgttaccaaactcccgtaaaaatactcaccatgttttacaaaaactgtctctaatagtgaaatgccatggtttccatccctggaagtatgaacatggccaactagtaaaggcattacaaattaatggcagtttccagaactgggaataacccattcatgcatatattctggcccaaagtagaaaatatgatgaattatagtctgcatatctgtatttgtgagtgttagtcctaagaaccacatgttaaatcccagctcatttgtgtgattttaaaaacgttgactctttcaagccctggaaatggaaaaagaagcaataaagaaaacacaaactgagggaatcaaggaaatgaaaaatttaggaattagaacaagaactacaaaggtaaacttcaccaacagaatataagagatagaagagatactctcaggcattgaagatatggacacatctatcaaagaaaaaaattaaatctaaaatatttctgacaaaagacatccgagaaatctgggacactatgaataggaatagaagaaagaagaatcccacctcaaagtcccataaaatattttcaacaaaaccatagtagacaaattttctaacctaaaaaaaaaaaagacgcttatacaaggacaagaagcatgaagatcaccaaatagattggatcagaaaaaaatccccttgccacataataataaaaacattaaacatacagaacacagaatactaaaatctgcagatggaaataacccaataacatataaggaaggcctattagaattatatctgccttctcattggagtatctaaaagccagaagagcctggacagatgtgctacagattctaaaagaccacagatgccaacccagattaccatatgcagtaaaatttacaatcaccatagatggagaaaatataatatttcatgataaagtcaaatttaagcaacatctgcctataaatctagccctctgtaaggtattagaaagaaaattctaacctaaggtggttacactacccataaaaccacagtaaataatctcacaccaaaagaagggaagtgatagtgcatgcacacacgcgcgcgtgcacgcacatacacacaaacacacacacacacacacacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaacaacaacaacaatcacaacaaaataataggaataaataatcattagtcatagatatctttcaatatcaatggttttaatttcccaataaaaagatacagactaacagaatggatgaaaaaacaggacccatacatctgctgcattagcaaaacatacagcaccaaatatagccattacctcagagtaaatggttggaaaaagatattccaagcaaatgaacttacaaagcaagaagaaagctggtgtagtcattttaatatctaacaacatagaagtgatagtttgaatgccactcatagggagtggcacttttaggaggtgtggtttcttttggggcaagttttgaggtttcctatgctaagggtactgctcagttttttcagtggacttcctcttgcctgaaagatgtaggatctttgcttctactccaaaaaaacttctgcctgcatgctgccatgctcttcttcatggtgataatagactgagcctctgaaactgtaagcaaactactcaattaaatgtctttcctataagagttgccatgggcatggtgtcttttcacaccaataataaataaataaataaataataaataaaaatctccaaataagacaatagacttcaaaccacaaccaatcaaagagatggggaaggacacttacatttatcaatgcaaaaatccaccaaaatgacatttcatgccagagtccagctctggatgagggcagggtcttaagatatgttgatgcaagaatggcaaagggaggaatcagacatgggacacatctaagttttgttttaggtgagatggacagagagaaagctcacctcctgaagagacacaggtcccagctggggatgtaaggagtaggtgagggaaggaagtgagtcagacagcctgaatgattagcagccagagtgcttctttatttatatagaatttagtaaatagggatatattcctgtttttccaaaacaaaccacattgtttttggttttaaacacgtttcacttccttttgatcatcttttagtcaccattaataaacagttatcattaattttccttcgttttgacatcattgataaacagttatctttcataaccatttttgctcatcagaaccataacccaatttttaagaatctagaggtatatgacagcttgtttatcaggcttgtagcttttgtgcctacaaggataccaaaacaaaatctccaagctaatctgggcagattgccatgtcccaagcaacggatattaactcttaatgggtagagtgcccaagaaatatcccgaggccaaagctactgcaaatttttattattcaaattctggcataattcaatgagtacactttgtatatttatagaattttcttatatgtctaatcctggaattgttgttccttggtcatatgacatcatagtgactctgcaagtgctaacttttctaagaagggaagtcctggcatcttattcttttgtggtctttcctctccattctttgttcatcaatataagtctctgtgtaaggcagaggtaactttagctaatctaactttgctgctttatatgacaagtaattgcctgaatgtttagtgggaatagacttgcaatctaaactatggccaatgcctctagaccgctgcattttgttgaccatttttgagtttactttgttttgaatatcttgttccttatacaaggacagatgtttcaagactgtatctgtcataaactcatgtctcaatatggtctctatcattattacaattctaaaaagagtaaaagaacaccaagagtcctaaaactatttacgttgccttcaagatggtaccaaagcctgccattaactttgtaaacaagaatcttttcttgttaatattagttttgtgtttcagaggcaaaatacaaattcctaataattcagtcatagtttctcagcttttaaaatttccctaaattttttttcttcaattatttgttccatatactatatctcatgctcattagtaccacttaagaagattcgatttcttttttcttttttctttttttttttgtggttttcaagacagggtttcactttggctttggaggctaaaagaacttagtgaattatcaaaaatattgtgaatttgttgatttgtagaaaggaatgtgttaggggatattaaagggaggaaatatgggtgggtatgatcatatttcattgtatacgtgtatgagattgtcaaatataagaataagaataaaaatttaaaagtaaattccttatattatagctaaatataacgaattatttctaacattctatagtatgtgtctataacatccccccaacaaagtaaccctacatataatgaaacatgttaaaaagaaggcaaataaataccaaatttaggatccactggctcatgtatgacagggactgcttccgtccaggtacccatgccctagtcaggggcaactgacaccagaggcctgctcatgggatccgaacttggccaagggattccagcacattcagagactgccaaggccacagtaacagtcctgcctccatccacaagaagagaacagaccagagtattggaactatttgcatctaccagaagggaaccttggacccatacccaccaggagaggaagagactcctgctacacccactggaagaaaggatgggaaaaagacaatataaaagcacattcaacaacagaaaaaccaatatgatgccaccggagactagggaccatacactagcaaggccagaacatcacaatgcagatgaagcagatgagaatgaccttaaaaatttttcatgaaaatgatagaggatctcaaagaagatataagaaaatacccttaaagaaatggaagaaaaaacaaagcaaaaaatacaagatatcaataaatctttcaaggaaaagtgttttcaagactgaaaaactaaatagaaacaataaacaaagcctaatctgagggatgcaggaaatagaaaagctggataaatggtcaggaactacagatgcaatcataaccaacagaatacaagagatggaatagagaatctcaggagttgaaaatacactgggaaaaatagactaatcaaccaaagaaaatcttaagtccaacaaaacaaaatatccaggaaatatggggtactgtgaaaggataaaacctaagaataataggtatagaagaaggtgaagaaatcaactcaaaggcgcagaaaacatattcaataaaatcatagaggaaaactttcctaacctaaagaaagacatgccaattaaagtacaagaagcctacagaacactaaatagactggaccaaaaaaaaggtctcctggacacataaaaatcaaaatcccaaacatacagaataaagagaaaatattaagagcagcaaaggaaaaatgtcaagtaacatataaaggcaaacctatcagaagtacacctgacttttacatggaaactctgaaagccagaaggtcctggatagatattctacctacacaaagagaccatggatgtaagccagactactacactcagaaaagctttcaatcaatatagatggagaaaacatgatattccatgacaaaaccagattcaaacaatatcatatccaccaattcagccagacacaaaattctggaaggaaaactgcgacccatggaagttaactacaaccagaaaaatataggcaatagataatcccactttaccaacagccaaaaggaaaaagggatagaatcccacacataatttcaccacccccaccaaaccaaaacaaacaagaatgaacaatcaatggtcattaatatccctgaatattattggtctcagcatgcccataaaaagacacaggtcagcaaaatggataagaagacagaatccatccttatgctgtatataagaaaaacacctcaacttcaaagacagacattacctaagaattaaagtttgggaaaagattttcccatcaaatggacccaagaaacaagcagggggagcaatcctaaaatccaacaaattggtctttaaactaaactcaatcaaaagagatgaaggatgtcacttactactcatcactggagaaatccatcaggatgaagtctcagttttgaacatttatgccccaaatacaaatgtatccatgttcgtaaaagaaacattactaaaactcaaatcacacataaaaccacacacacttatagtgagagacttcaacaccctactctcaccactggacaggaacaccagacagaaacttaacaaagaaacaaaggaactaatagaagttattggcccaattgggcttaacagacatctatagaacattccacccaaacacaaaataatatactttcttctcagcgccacatggaaccttctctaaaatagaccacatacttgtcgacatagcaaacctcaacaggcacaaaaaattaaaataaccccctggatattatcagaccaccaccataatttaaagttagaattcaacaacaacatgaatggcagaaaacctacaaactcatggaaattaagtaacgcccaattgcacaattcctgggtcaaggaagaaataaaaaaaaagaaagtaaaaatttcctagaattcaatgagaatgaggacacaacatacccaaacgtacaggactctctgaaagcagtgctaacaggaaatttcatagtgctaagtgcccacatgaagaaacaggaggataatcacactagagaatgaacagcatgactgaaagctctacaacaaaaagaagccaatacaccccagtggagtagatgccagtagataatgaaactgagggctgaagtcaacaaagtggaaactaggagaacaatacaaagaatcaatgaaacaaagagttggttctttgagaagatcaacaagatagacaaacctttatctaaatttaccaaacagcagagagtgaacatataaattaataaaatcaggaatgaaaatggggacataacaacagacacagaggaaatccagagaatcatcaggtcatacttcaaaaacctgtattcctcaaagttcgaaaatctaaaggaaataaacaattactggacagatttcacttaccaaaattaaatcaagaacagataagcaagttaaattgacctataacccctaatgaaatagaagcagtcatcaaaagtcttccaaccaaaaaaagcccaggaccagatgaaatcagtgcagaattctaccagaaattcaaggtacagctaacaacaatccttctcaaagtattccacacaatagaaccagaagggtttgatgacctctttttacaaggcttcaataaccttgataaccaagccacacaaaaacacaactaagaaagagaattacaaaccaatatccctgatgaacattcaggcaaaaatactcaataaaatactggcaaatcgaatccaagaacatatcagagaaatcatccaccatgattaagtaggcttcatcccagggatgcaaggatggttcaacatatgaaaatccatcaatgtaatccaccatataatcagtctgaggaaaaaatcacatgatcatctcactagatgctgaaaaagcctttgacaaaatccaacaccccttcatgataaaggtcacatcaaagaaaatggagagaaatgcaatgcaattcctctaaaattgggcagaagacaaggctgtccactctctccatacctattcaatattgtccttgaagttctagctagaggaataagacaacaaaaggagatcaaggggatacaaattggaaaggaagaagttacactttcactatttgcagatgatatgatagtctatataagtgacacacaaaaaagctataccagggaactcctatagctgataaacaccttcagcaaagtggcaggatacaagattaactccaaaaaatctgtagcactactatatacagatgatacattcatggagaaagaaatcagagaaacatcaccctttacaattgccataaaaaaacataaaatatcttcccgtaaggctaaccaaaaaaaatgaaagacctttaccataagaattttgagtctctatagaaagaaattcaagaagatattagaaaatggaagaatctcccatgttcttggaaaggtaggatctacatagtaaaaatggcaatcttgtcaaaagcaatctacagattcaatgcaatccccatcaaaatcccaagacaattcttcacagaccttgaattctcaactttatatggaaaaacaaaagacccacgatagccaaaacaaccctttacaataaaggaacttgtggaggcatcaccatccctgacttcaagctctattacagagctatagtctgtaatgcagcttgatattggcacaaaaatagacaagtagaccaacgggatagagttgaaaactctgatattaatgcacacacctacaaaaacttgatatttgacaaagaagctaaattatacgatggaataaagaaagtatcttcaacaaatggtgctggaataactggaggctggaatgtagaagactgcagatagatccatgtctatcaccatgcacaaaacttaagtccaaatggatcaaagacatcaacatccatccagccacactgaacctatcagaagacaaagtgggaaacacccttgaattaattggaacaggagactgaccgatttctgaacattacacaatagcacagacactgagatcaacaattgataaagggacctcctgaaactgagaagcttctgtaaggctaaggatacagtaagacaaaaacagcagcccacacaatgggaaaagatattaatcaaccccacatctgacagagggctgatctccaaaatataccattaactcaagaagcaagtctccaaaacaccaaacaatccaattaaaaagtgggttacagaactaaatagacaattctcaatagaggaatctaaaatgattaaaaggcacataggaaagtgttcaacatccttagccatcagagaaacgcaaatcaaaacaactctgagataccatcttactactgtcagaattgttaaaatcaaaaacagcaatgacattttgtgctggagaggatggggagcacttctctgttgctggtgggagtgccaactcttacagcaactttggaaatcaggaaaatgggaatcagtctactacaagatccagcaatcctactcttaggcatatacccaaaagaagcacattcacacaacaaggacatctgttcaacgatgttcataacagcactatttgtgatagccagaacctggaagcaatctagatgcccctcaactgaagaatggatgaagaaaatgtgctacatttacacaatagaatactactcaaagataaaaaaaaatggaatcttgaaatttgcaggcaaatggatagaactagaaaaaaccattcctagtgagataacctaatcacaaaaagacaaatgtggtatgtattcacacatacgtggattttagacataaagcagaggattactagcctacaatccacactgccagagaaggtagtaaacaaggaggaccctaagagagacatacatggtcccctggagaaggggaaagggacaacatcttctgagcacattgggagcaagggggaggggaaagggagctaggagaatgagaaggggagaagaggagaggtgaggaggacatgagggagcagaaaggttgagtccagggaataatagaagaaaccaagaaaggagacaccataatagagggagacattttagatttacagagatatcaggcactagagaaaggtctggagatctacaaagatgacacaaattaacaatctcagcaacagaggagaggctaccttaaatgccctactctgataaagagattgatgactgacttatattgccatcctatagcctcatccagcagctggtggaagtagaagcagacacccacagctaatcactgtactgaactggaatccagttatagagaagaacgagtgatgagcaaaggggtccacaccaggctggtgaaacccacagaaacagctgacctgaacaatggggtgctcttggcccccagactgatagctgggataccagcatgggactgatccagaaccctggaatgtgggtttcaatgatgagacctcagaaatctatgtgacctcctgtagtagttcagtacttatccctatcgtatgtgtgcactttgggagcccaacgacatagagggttactccctgagccaagacacacaggagtgggcttaggtaggccctatcccaaaggatatgatagactctgatgaccccctatggaagggctcaccctccctggggagctgaaaggatttgttataggtagggttttagttggagggggtggtaggggaggatgggagggagtgggaactggaagtgacatgtaaaacaatattttcctaattcaaattaaaaaatgaaaaaataaaaataaaaagtaccatgattatgtgtacccagctttataactataatcatctgaaatgctgtaataggctactaagttgtttttttttttatttcaagttatggaacaagcttgtttcacatgtaactcccttctctttctccctcccctcacccccatctgtcctcccccccaacctagaggctcggcaaagtccaccaaatctttctgtgctgggcctgggcccttccccatgtgtccagggccagagtgtatcccttcacatgggatgggctcccttctttcaccagggaaaaatgctaatccactaccagaggctccctggattgcagaggcctccttattgatatccatgttcagggttttggatcagtcttctactggcctcccagacagcatctggggtcgatgtgctctcccttgttcaggccaactgtttctgtgggtttctccaacctggtacagaccccttcaatcttcattccttcctctcttcaactaattacctgatttcagctcagtgtatatctgtggatgtctgtctctgcttccatcagccactggatgagggctctaggatggcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcatcctgctctctctcctctattcttcccccagctcaatatttctgctcctccatttcctgtcctctatttctcttctcctgatcttattgtggaagctccctctcccctaccctcatgttcccaattaactcaggagttcatgccacttccattcctggggtccatttatcccttagagtccttcatgtttcctagtttctttggtgaagaggattatagtttggtaatcctttgctctatgtctaaaattcatatatgagttaatacatacaatatttgtctttttgtaactgggttacctcactcaggatggtttcttctagttccatccatttgcctgtgaatttcaagattccattgctttttttctgctgagtagtactccattggataaatgtaacacattttctctatccattctttggttgaggggcatctagtcagccagacacaaaattctggaaggaaaactgcgacccatggaagttaactacaaccagaaaaatataggcaatagataatcccactttaccaacagccaaaaggaaaaagggatagaatcccacacataatttcaccacccccaccaaaccaaaacaaacaagaatgaacaatcaatggtcattaatatccctgaatattattggtctcagcatgcccataaaaagacacaggtcagcaaaatggataagaagacagaatccatccttatgctgtatataagaaaaacacctcaacttcaaagacagacattacctaagaattaaagtttgggaaaagattttcccatcaaatggacccaatgcactctcttaagtgtctttcagccatttcagattcctttgttgagaattctctatttagttctgcaccccactttttaatttcattgtttggtgttttggtggctagcttcttgagctccttatatattttggaaatcagccctctgtcaaaagtggtatcggtgaagatcttttcccattctgtgggcagttgttctgtcttactgagtgtgtcctttgccttgcagaagcttcttagtttcaggaggtcccatttattaattgcagacttcaatgtctgtgctactgacataatgttcaggaagtggtctcctgtatcaatttgttcaaggttaattcccactttctcttctagaagattcagtgtggctggatttatggtgagatctttgatgcatttgcacttaagttttgtgcatggtgacaggtatggatctatctgcaatcttctgcatgtctgaagccaattgtgccagcaccagttttgaagatgctatcttttttccattatatagatttagcacctttgtcaaaaataaggtgttcataggtgtttgggttaatatcagggttttctattcgattccattggtctatctgtctatttttgtgccaataccaagctgttttcagaactatggctctatagtggagcttgaagtcagggatggtgatgcctccagaagatcctttatcataaagagttgttttggctatcccgggtttttctttttccatataaagttgagtattgttcattcaatgtctgtgaaaaaggctactaagttttttgatgaaatcagtcactactatgtccaattaccactatatacatgtgatctttagaaataataaatgtgtgggtgtagaaggaacatgtcttccctgattgaggtgacagtgtttccaaatgcaggcaccaggggatgagtttccaaatgcacaaagttttaggacaaattagaatcccctggagtctttacagtgtggaatttgagtactggggatgtgacaaggagaaattcatatcatgagaaactattcaaaaatagtgctgacaaaataaacaaaagcaaactactcaatacaaggtaagtaaaacttaaaaaaaaagtatgagctatggaaaggtgggttgagtatgggaatcagtccctgagctctgcctggctttcatggccttggattatattttgcagtcttgtactctgtgaaatgttgcaattttttcttttaggcatgggtgttgctcatgttttgggtggtggtaggtcttcctgatccggcttattcagactttcacttttaggtcttctgggaacatcctccctgaaatacccatgacagtgaatgatcagctttctaagtgtgtcccaactaactcaatgcaagtgcgttagagtaagagaaaacccagaatatttgtgcatgtgtatgtgtgttacatccacacgggcaggtgtgtggaggccacactctgatgtccagcaacttcatcatcactccccacaatttagctccttaggcagtttacccatggatcccagtgcctgtctcctgagctccagaattacaggtgggcagcacacccacctaacataaagatgattaatgccatcagaactccatttctcatgcttacataacaactatgttaccatctgagccaactgccaccaccaaactagctttgctcccacatcagtgatggaaattgtgaatatagggattttgatatacagaatttcctcattgtgaggtttaatattttgtgagtttagcgactataggcttttatggttttaaactttatggattttacactatgatttaaatctttcgggatttgaactttgggattatgatttccaggattgtcgtgatggattctacactgggccattgtaagtacaccattacatatgcattgttattatcttccacaaaggtaatatgacaatatcttaataaaatacagaatcaaagtaaactaaaagagaattcctacttccccagacagaacggtgatttgatatggtcaatctgcttggtgtgtatgacagagtgttcccattttctcagatacatactcagttgtaaaggtctctttttaactaaattccagaccagataagttgattttgttaggatcaaactgcactatatgacttacataagagaaatattttgatgcactcgtttgtgcttgagtttttgttttaaggatgagtgaaagtttatataaaacaatccctagggccaacaaggtaaaggtgcctgcagactgcacaagctgatgaattgagttttgactcctggagcctacaaagtggaaggaaagaaccttctgcacaaggttgcactctatcctccacatgtgctctggagtgaggtcttcttccagtaaatatatcataataaaaacatacaatgattttgctacatggatgttcactttgtaactgagttttcaactctttcttcatctctaggacctacttttacatttctgatgatactatggcttagtagttaccagaagaaacagtaattttatttatttatttcaagtaaacgcatcttaaaattgaagttaattttctacatttgctgtggtattcgtgtggtaatgtaccctttagttatttcaaaactttactctttgcaataatttgtagttggaaatctgtggcttgatatttaagccagttcagactttgatttattaaaccagatcatatggtatcacagagtaattgtaataggctagtgagaaaagagaggcaaattgatctaagggtgaggtgtttaagccacagcaagtcaaaaatctcctcaaggaaatgttttagcagtgtttgttttggtttgaatagaaactgctttatgttgaaccaatggtctgtgtgtcatcatttagtaacattagcaacgagaggagcagtctctttatagtaaagactggaaaagatattttactgtacattatctgatgggttctcttgatattggagcaatgtattgtttaaagtattttgctcagctccagcaaatcaatcaggtgcaaatataaatcctactcaatcaatttaaattttttgaggtaaagaattctctttgtatttaactcaggttttctttttttttctttttttgtctatgaactaaatacaagggagacttattttgttttttatagttatttgtgacatgttataaagaaaattttaagttaacactataaacagatacaacaagctaatactagaaaccaaaatagaaaattagtgctagaaacataccagaaaggatgggtttatttacatatgagttaggatgtaatagaatattctaatgcctaaagcttagtgttagtgaatccgttattttatatcttatatgtctgtaatgtaaaattatttcacctttcagaatcacattgttaattgttctggaattgttctgtttaatttctaaacaaaaggatgagggagttgcagaaatgtgaagatagatacacaactgcacacatgggaaagactactagagtttcacccactcaagccattatcacattagtcatcttgttaagaatacatcagtatttgataaagttctcacttgtattaagaagtagcatgctatgagagtcaagagtgttattatttttcagctttgcattaatttcgaaggaagttttcctctgtcttggctgtttgagaagtttacagtgggttggttatttccaccagacatggtttgtgaaatcaaaataggtccttgtttttttttttgacaaaaataaaaggctgaggccaaagggtaaaggacaatattatttagatttcaaatggaatgagaacagacaaagggaaaacgagatatggcattatgtgctcacatcaatggcagtaattaagctttgcagtgtcattagacatgataacaataatttgtagcctttcatggtgcttttacatgctaagcatgcagaaccacatgatgtcaagacccttagtatttctcattgttttatttttttctgctaaggaaataatggctttcaattgtcatgagatggggagatgcacaacacaaatttggattctcaattgcaaagaagaaaagagaagtgtttcatgatttttaaccatctgtaaaatgtatggcagcaataaaatgctaacaagacatggagatgactacttccaagagtaccgtatttaaatttataaaagttaatttagcattatattaaatgagaagttaatgttcctacaagcccagcaactgaactatgacatattataccacagtgttgaattgaaccaaggatattcaagtttttgattgtgggaaatctgtcattaaccagttcaaattttctactactgtgattagtgtagaagaaaacccctggatgggtactttggaacttcagagcccacagtaagaaattagaaagacttaagtagctaaatatttaatttcaatcaatctagtgggcagtgtttacagttttctttttggccattcatttaaaatgagtttctattttgtctgcttttcaaggctctattagagggtattctaataattagaatttctctgaattgcagttctgagtctttaagtgcccatgttgataatagtgaataagcaatctatgctttaaatttaatttacaattatgaatgtcagtgtggtcacagtctttagcctaacgctgagatctttcaattgtaccagatattagtgtttgaggaactgctttaagacagatgaattagtaaactcaatggataggaagtgggtgcaaagtatctatttctcctctctgaggagttgccatgtaactgccaggaagacaggatgcaagacctgtgtcctccataagacaagtattatgattatggttgatacttaagactgagctagcatataagaaatcctagtcaattagccagcagctaattgtaaactaatataagtctctgtgtgttattctgggcgccgatatggcatggctcaggcagatggagtaaagacttatcattacaaaatagtaccaagagtaccataacccatcgggcagaactcaggtggctggcggaaagacttatcattacagcaatccataccctgaagcaggtgtgctgcagcatctagagagtgctgagggtccctttgtgctgtcaggagcctcaactgtgctaaagtaggatacccagacctatgccaacctgccctctctaactcccttaagtttgacacacaaaccatgagtggatccctggcttttgttcattctcattgtttgtagataaaaaacttaattttccttatgagtgcaagaattttgtctcacatattcacacaattagtagaaattctgcagaaaatattagaaatggcctaagagacaagacactcacttatcacagaagcacattattcacactcaagactctttggtctgcttcaccctaaattcaagatgtagatttgaaaaatgttggccacccactcttctctccaatgtaatccagtgtttttcctttatatgcaatcactttcattcctgtagaaggttttttttccctaccctactagcaaaatcaaactaattatagtatgtcttttatgtcttcatttttcatttcagtatcaaaaagcatgctgaacattacattgtaaacatttcaatgccttgcttccctgcaatatcagaaagaacagcttataaaaccctttacactgtccttgatagtctagcaaacctctgatgaccaaggtctttgcactatcatcaactgccaagtcaagataacaatatctaactcatgagtttttaagagtatcagaaaggataattttttccattaggactaggctccataattctgcatctttactggttatggtttttagtagttatctatctgttgcaaagagaagtttccttgataaggtataaagattatacttatctttagttagaaagataaatgtttatgtataaacataaatgttgttaggggttatgctagtttagtaaagctgtgactagattctcctgcaataaccatgactcaatgagcaccaaatagtttcctagatttccagtaccatatataatttccttctcattgaatgagtcttaagttggctacactcaaggaatgtgtgttattactgaattcatagggttatcttgtcatactggtcattaatatggtttttagacaccatagttgggtaggatttttggttgcctccttcctttgaaagttttcatgccacgttctggtgctatgtagactaatcctcagtaatgtgttattcagggcatttctagcttatgggtctccagtctcttttttctgaaatgcatggtatttttagcaatagttactaagcttccacctctggtggtaaccaaaggcaaacagccataggctttatgtcttaagaatctcttggacagactgataaacaactaaaaagtgtgtttctcatgcttgcttttggaggggttgctaagtagtctttggcttttggagggggcattgtcagccattaaattacagttcattaaagctatatttgaatatttatacatggaattttgtgttttatagagatttatttgttttgtgtgtgtttgtctacaaaacactcctacaactaagactcggaaaagattgcagagggggaaatgggttgtaagagacaaaggaccagggagtttgctgtgagattgtgtctcctagaaatgttagaatctatactcataaagtcttactcaaatgtgagctgaataaatataacaaaaataaatacatcaaacttgatacaaaaaatgtccatgaagcctcaaccttatgcaaagaacaacagtcaactgaggaaggcttggatggggtgaggtcttcctcagggtagagtacattaattcattttccagtgtgaaatgttcatccttgaatacacatcattatacatactgaacaggtaatatttaggaatatatatatatatatatatatatattatatgtttatatttatatatgtatgtgtgtgtgtatacatatatgcatgcaaaaacaagcttaaggacttaccagtctggttcgataacctgatatcatggatgaaatgctagagaattgtttttcttattacctcttctttgccagctcatgacctcagtgattctcaatacattcatatattcctgcagaggaaattgccaatatgagtgatatctggggacagttagattgactcattcactaccagaaatatatggagtttcaatagagtgtggacgcttagagaatcgataattctttaagacttttgattaccctgcaaaagatctataactattttctccattgactttctcaagttgaagtgtttcacttttcaggtaattctttcttcaatcagccatagacacaggattaaaatgaatgatagtgaaaaatcatggaatgtacacagttcaacattgagaaagccgctgttcctaactgaagttgtctttttgaggatatggagatgagactgcttatatatttctacatattctatctccttttccactaagcaacatatattatttttagaatttctcacataatgataaatttaattctgaaaatagtgaaaaaagttacagaaagataacagtttagggagttacaaagtatgttgggtgtgtttgcttcgttctctataatctagagtgactttgtgtaatatattttagttttatatgtatatatttaatatatacatatatataatattcatgttgtgatttgaagtgtttttatagtatatacaatatttctactttaatcacaaaatattagtttaatcatgggaagtaagacactattatagagtttcctaatatcattattcatcatgcaagtatcatgtttgtacacctttttgttgatggaatttttttcctgcccactagttcccaaattaccaacctagattctcagtactgcatgttcatcttgcttttctctgcatctgtttactacttctctgactctgtccttcttcctagcattttcattttggttctccccataactttgtctatccaactattggccagtcagcttctttgttaaatcaatcacagcaacatacagtcacacagtataaagaaatgttctcctctttttgtctaacttaaacagaaggttttaactttagcatagtttatatacaacaaaacagttattaagtaagaactacagttacaatattcagtccatttgtattggaaaatttagagaaaatattcttgtcttggtgagtctaaagtttcatacctattttatcttttgtcataactaagggaaactttaaatatgactatcaagtcttcaactctattaaagaccccagaaaggtgaaatgttacctaatgacagggacatctggcttcttggacagtcaccctaggttcttctgtaatgctaggacatccaattttgcctacaagcctagtatatctgataaacatttctgagaagcagagaattctgaaggactctcataccttgtgttggcaaagttcagaagttaacttttgtgcatcatgctggtccagtttggacagtatactgtcagcaattgagacaagggcagtttctttgcccaaaaggctagattttgccataaagaaaccaaacttcatactgaggttctttgatgcccatcatcttttttgaaatctattggtgctatcaggagcaggcatgtatcactgtcatgaaaaacctaaggttattaaacctattaaatatattaaatgccatattcttaggtctgtgaagtttttaaagactatctatctatctatctatctatctatctatctatctatctatctatcatatattaaatacatctgtgtatgaccttgaaaacataactaatattactatgactgttacagatgactattaatcttatttcttaattatatgttacattttaaatgcattgcctaagcacattaccccaaataagagtagaaacatataatatagtaaaaataagtttaaatttgcatcaagacaccaaaatccataccaatgtaaaacatttttagattaatagttgtcttttagattaaagtagcttcaatcatataccctcttattctgtcatttctatatcccctttttcttctaggagcaatatccctgaatctaatttcttttgttcagcctttttttcctgaccattaccaataacaacttaaaatccacccccttaaatgataacaaacatccataaacaatattttgggaatgtgagcaactatttcctattctctgggggtgctggtatctttgaaggaaccttaagaaaatcagaataattgttaagatatgtcgggtgttgtttgtgagattggaatatctcagccagcagttttgaggatgttttggatgcataatcttgacaagaatttaacagaggtgttttgaaatgctgatcactggggctacacattttaattaatgtttgtttcccttgttctgaaaatgcataaactgttaaaggtaacatacaagtatggaatatttggtgtgcacaattagttaaagatgatttttttgttttatgtttgagcaggtaaaatatatgttacatgtctcataggtttttctagatttacttttttatgtttatagtcaggattttcagaacattttccttgatcaaatctgatcttctttaaccttgaacaaatccactgccttttatttcctgtgtaaataaaggcataacattttccccaaagtaacatatcttttgacttcaattttgaaatcaagaaaattttagaatacataggtttctttaatccagcaattttcataatcaaatgtgtcttagcagctgttgttctttcattggcaatcagaaaatccaaagacaacacaataaaatacagaatctagactctctgtgtattttccatttttacatggcttattatataattttctctgttcctttttaagcaactttactgttttttaaactactttttaaatctatgactgcctctatcttttctcttttctctcccaagcctgtatgcactattgaacacactgtaacactgtttgtgagtattttcatctgatctgtctttactacttatctgtaacctctcctgactgcatgagcaaaaccccaaaccctccatgcattgtgctctccaagctggtattggcagctcaagcccataggcagcaactaggaaatgcctctctgtactgtggcagatgtgagagactgcaggaacctgctatgtagcttaagtcatggcttgctagcagctgacaggagacgcatctctgtactgtggctgacatgagactaggaagctgcacaaggctccatcttttgtacatttaaaacctttttaaagctgtctcaggtcttatttggatgtaggtgctggatgtctggtttttctttctggcctgccagttcccaaataatcagcatagatacttaacattaattataaatgctccatcaatatctcagacttgttattagctaatgcttacattttcaattagcccatatttttatctacacttctttgacacatagcttggtaacttttctcaggacagcatgtccatcttgcttctctctgctactgcttgctactcctctgactctgtccttcttcttcccagcattctctgtttgactctccccctaaccttattctctccagccattggccagtcatcttctttattaaaccaatcacagcgacatatattcacacagtataaaggaatattccatgctttttccaattatttatttatgcatatattccctcattcttttataatttcatccccttgacaaaagtgctacaattatataattttcaagtgttcacaaccctaaaggttacatatttcttattcatatatttttctccattgctatttactataatttctcactttactcaaactaaaggacgtggggtatacagccaatgggaggtacttattggaagaccctatatatgtaatactgattgtaaaatagaaaaaaaaatgcacttatttccatagaatgcaaaaccattttgccctcaaattatttaaaattattaacaatataaattcaaaaacgactttaaaatgtctacatgtgcacatttttacagagatgatttgttttgatacttctgaacttataaatctgttaaaattctctcagcaaaggctaatctttgattaaaaatgtcttgcttgcgcacttaaagagttactagtgaagattttgatgaaagggagaacatactgctcagtgtgagctagtcctcctgaagaagatggaagaggaagaggaggatgaggagaatgaggaattagaagcagcatcagcagctatgtaagaaaactttgctttgccatggcaagtctgtattacagggcctgaacaccagcattaagtcctctattgttaactgaaaatgccactgtggtttcagcaggtggtcacctgtctgtgcaacagtgttaagggccagtgactcaagatgacctgtaagaaaaagtaacctgttcaaaacaagaggtctgctgtgtgttagcctgtgatgtgtgctctcactcactgtaggcatctctgttccttttcctgtgtttgtgatgaaaatcccttcaaagaagcaactggaagtagaaagcattcattctagctcgtagtgcaaggatgcagttcctcatggtagggaaatgaaggtggcaggaacttgaggctgttgatcacatctcatccaccatcaggaaacagaaggctcaatgctaatgctgttaactctccttttcatacagtccaggactccatccagggaatggttctacccttacctatgataggcctccccactccaattgctccaaataagatgatcccttataataatgttcatgggccgataatccctcacaggcatggttggaagaccatctgctacattatcccagatccttcaagttgagaagtaaatctaacaattacaaattggaaagttactcctagccccagttgaatcgaggttctgaaatatggctctatcagtcatgtcttatgtagcataatccaaagtggttttctctctctctctctctctctctctctctctctctctctctgtgtgtgtgtgtgtgtgtgtgtgtgtgtgtgtgtgtgtgtgtgtgtgtgttgccatacaccttacattggtgggaatctccttaaatcagatgatgttttaaaaattactgttaccataattagcaaccccagatgccttgaagcaccttcaaagccagttggtgggtagtctgccttttatttctaaagggaacttcccgtggcagttcatttcagtctcagttttcatttctagaatccctgggacaacgtattttgcacctgatatcacctgagaccttgaggttgtgtcagtcctgtgcagtggtgtctcactgagcttgatgttgaatgaggtcacattcctgatcacaggtcattaatgaccatagtgggggcattgccaacaagagaatcagcaaatgcaataggtgtaggatctgttcttcagttgttaaactggctgataatgagttcatgctcctgctcttgaggctgttttcatggtagtgatgtgtcttgtgacttccttaagtccaagtatgaggaaaatttcttgagggggtggattgtgaaatagacagatgatggagaaaactgaaagcaaagcactataggccacttctagctagagtgtgagtgtagacatgggggctgaccacattttgaggaatgttcagctccatgcaaatcttaggacacagaaggaggaagacagagaggtgatacaaacatgactggggagtggatggcaatttgtagcccctctttctacttagagtatggtggatggatatctctttacttcattaagtattattctaccacacaatttctaagaccacagagtattctattattgaattctttgtctgaaaggaatcaacttaatgacttagaatgtcttaataccattaagtttttgtgtttactattcatggtcgacaacccaggacactttgactcatgtttcatggggaaaaagaaaggggacaagagataatgtgattaaaaatagagattggaattattgtttggggaatgctattttcagggtttgattatagtctctcatctggggaagtataagaaaaaaattagaaaataaaagacaaatttgacacgatagccataagcttttgcattaaaataagaagaaaataatgtccatatatcaagagaattaggttacaagctagagcttgcaaacctcttcacacaatcaaatgtacttcccaaaaggaattaatagtattctactttattttcattgaaataaggttagagactctagctctggtaaaaatttagcaactgaatgcccaattgaattaattgaactttcctgggaagaagaattctagttattgcttttctatttttctgaatttgttgctattaaattacaataggcacttaaagtggacaggagcattggcagtggcacaagagtccctggccactctgttcctgggtgagccactgaggatgaagtctctgactaaggtaaatataaaaactagaactttggaaaaggatgaaaatgaaaacaacaaccatcaaacaaaaaacaaagaaacactgtggaaaatatgagattttttgttgttgttgtttctgggtgtatttttcttttcctgtaggattcgtgtaagaaatgggtactgttgagcttgtctgagctgcaaatataattgcaagctttgaagacttatgaaaataagagggatgggaatcattgggggccagaaaaccagaggaagggagattctactaatctcttcctgttgaggatgagtgtgatgtaaatgaaggaacctaaagaggcccctttccacacgttttgatgagatgtcattcaggcaagctcttcccatcaaataagaatatgctgaaatgaagattttctcacttgttgtcatcaactggtagcatgaaataaatcctttatttcaaaaggaaatgtgactgatagctcccgtttgcctttcaaatgatcatttcattttcatttcccatagttcagcattttctctctgagagttacatttctggttagaataagaattgccaagtggaatcaaatagcaaaagaatgacaaagctctatacatatcattccaaatgatgtgtttgcctgtgacaggctattctgctctcatatttttgataagtcaggaattctaagaatactaagagcatgaaaatcacaggtagtgttttctgcgagatgttctgtgtgtacacttggttgtattcttcaaagggtgagggaccgaaacttttgtcattctaaaaatcctctgaaaatctgtgtagtgtggtttcattatgaatttttgcatactgcttcttcaaataataattgactgattaagatgtgctttttgttaatatttcagcttggcaacagctttaggacatagttatctcctctccctatggactcggagattcgggtatgggttggtctgtggctaccacaaccaaaaagcagtgcaaagctggggaagtcattacagggactgtagtgtgttgattttttgtttttttcaattttaaaaaatttaatttagaagcaatcttattttacatatcaatcccagttcccagttccctctccctcccatgctcccatgctcccatgccccccaccgatacccccatcccacccatccattccccagggagggtgaggccttccatggggatcattaaaatctgtcacatcatttggggcaggccctaggccctcccctgtgtatcttggctgagatagtatccctccatggggaatgggctcccaaattccatttgtgcagtcgggataaatattggttccactgtcagaagtcccatagactgcccaggcctcctaactgatacccacattcaagagacttggttcagtacaatgctggttccccagatgtactgttggggtccatgagctcccacttgaattgttttaaagactcacaatggcaaaagtctttgaagagatccttgtatgacaacagagtacacttctgtcctcactgtctgagcacttttgttcccaaactcaccatagcaagaggagctggaaaggtaggattcatgctctggttttctgcatttttaacagtggtttggggagaaagtacaaagatgacttgacaaagaaagtgagaagaaaacctcaggaaaactagacagcatgaatttaaatagaccaagcacttagggatatgcccacagatactttttgattctatatccttaaggaaatgatgactgtgaatgagtattttctaggatccttgtgtccaaaacaccaaaaaaacactccacgtttttaaaattctgaagattctgatagatagccacgataaaatgtgacaagatgccagctgtgtcctataatggtgtaggttgaatggattaaattctccttcagtcagattcaagattaaactatgttcttagaagttttgcactctaccctatatagtgcattcatgataatgctccttcagtttcagacagtagtgagcagatatttttttcaggctgtccattttttaaagaacattagcaaaatggggccggttggcttgaggaatctggacatagaacatagcaggtagggaaaaatatcctgatttgactttcaagatcctacagatgcaaatgattccagtgcctactgagcaggttttaggcccactatcccatccatgaacactgccactccagttgattttctttccatggtctgagtctttatatgtgaacctcttcctccattttcatgtgacttttctcataggaaccaaatgattcttaccaatagacacaatggaaaaggacattattttttatataggtggaaacttgttagaacagacataatgtagataaagttaaaacaaataaaactggacaaagcaaaactagaattctccctcaactcaaaaaaatgatagttgaacagatatgctaatatctttattctgtgtgtaaaaaatccatatatatatatatacatatatatatatatatgtatatatatatatatggattttttacacacagaataaagatattagcatatctgttcaactatcatacagctcccacagctccaaagactcaggcaagggagttagacctgtctttataccccctcccaagtgctattggctcaagcagatgactctgctgtgttgtcctttcctcattgctgtctctgggtcaagtgactcttggtcagcagtctctgggtgtagaggcaggcttagttcagggaggaagtacctgcctctgcctcacaagctcatacgggttgtcctgagcacctgggcagggcaactgtgggctggccacagtttctcccatatatacatatatattcagagagagagaataaaacatgtattattttgactaatcaaatagttcatacagatttcaggggtttaaaagcagagtggagtttcccaaggggaagaatgatgaagaaagatttatgagaactttacagtaggaaattagccatgggtcattttaatctccacagtgatgtcaccttacagagatagatgctgttagcaatggaggtggactgccaccatcaagtgcactctagtgtcatcttgtgccacatgggagtggaaaatgatgaagtcatctgtcatgaaatcggaacatgtaggaaaacaataaagcaacctgaaatctcaaacaagtaaagtcttaagatcccagggttcttctgccaatcatttttttgtaagttatgtgtcttttttttaaatataaattctgaactcctcatgcttctgtattatcctacaacttctgttttcattttttgcacacttgaatctaagtgtgtgtgcatacctgtgtgtgtgtatgtgtatgcgtgtatgtgtgtgtgtgtgtgtgtgtgtgtgtgtgtgtgtgtgtgtgtgtatgcagctgcatgttcatgcacaagtcttctgaggcctgaagttgatttaggaaggtcttctcagataaattcccatgtgtttatttactgaggcacagtgtcttgctgaacccagagttcattgccagttcctgctagaccaacaaatcatcttatttgggggatctgctgtttctatgccatatacactggccttcgaggcagcccaccatgcctgcctagcctttacataggatcttgggatccaagctcaagtcctcactctggcatggagatagctttatatgctcaactatttccccaccccctgattttgagtcctgcaggtttaaggaaaaattagaaaaaatttggaatggataaatataaattgggaatacatttttattttaagtaaaatgttggtattttatgaatcttttaatgaaagaaaactgaattctatgattcaaggtcagaatattaaatgcgtctgaagctgtgcccatgttcataccaacacaacggaggttcataaagtacttatgcatgtcaaaacatctatgaatgtccttactcaccgctgtggcctttaacaagcaaaatgattataatttaaaagcacttaaatacaatctgtaacaaaggcatcaaagcagtccattaaatgatggttttagcctattcttgacctttcttagcctattcttgactttctgataagcaggatatggagagatattattgtgaatacaatcattatttactaatagtatgttttaaaatatagataagagaaaaaacccaaaatattgatataatggctacagacataatttctttaaacaatgttctgctttatagttttatttttttctgggacaaattgcagagcataaatgattgctcagttaaatagcagttggtgtaacattatttaatataacatctggtcccataaaatgcaggatattgagcattcatattatcttgtatacaataaaaatcaaaggtaaaattgtgcaatttgattaaaatacattaagatgctttcaaacctttgactgagatggcaaacttgtttggtccttaggaagataaatgggacatcgcctccctgttgtaaaatcattccaggtgcagactggtgtgctttttctctgaaacatgtcaagtagagaagaacagaactacatgtctctttggtggtaaatgggaaattaagaaaaggctcttgggtgaataacaaagtgtttatttcaaagagaagaaataaaatagaaagttttatctgctgttgaggttggagagaaattgccttaacatccctgcagtctgttttccctcctgcatagatgcacaccagaaagcttatgtgtatactaaccattctgaaaagacagatttgaagtactgcttaaaaggaggctgggtgcacactactcttcccaaatatagttagattagtaagttagggattgatctaataatgcactagatgtttgagtttaagattaagacccatgtcttttcctgctgttgtgactgtcatccaaccaactatgggcttatcatgggcatcttccatactccagggttgtctgcagagatttgcaaaatgatgggttttgactttaaacacattagctgtttgaatattttaaactccatccctgctttccctcagaatgaacatacagatagaaagaatgcaatttgagagagtttcggacttttcttcttcattaatttgtgagatctcataccatttctctccaatacactgttaaaacagtgtcaatttcatgcttcacacacctggctttataggtggaggctttttttttccagaatggtcgaactgctctttggaatcacacagggtaaaattccagactcatgctgtcctgttgctcctgcctccattatggccggtcatgctgagccgaggtttccactcacattgtagacttgataacatgcaggttcactttttcatcttaacgggctgaaggaggggagactggaagcaatttggggtttgatgaggtgcctagctgacacttaggcctgggtttctaaaatgtcctgaagctaaattcagaagaaatggagttgattcttggtaagttcctgctgccttttgaatgtcactttatctgctgctattggttttgataggatcattatataaccagttattactatcttctgtaaccttgggctgtctgtgaccctgaacttccttttgataactggttcagatgtattttttactattttggctctggagtaaacttgggatactaccatccataaagttctgccctattaatttgcactaattgctttgaattatgattaaattttatttggttatggacaaggcatgcacgtgcctaagtgtctagttagggcaatttattaatgtttaaaatgctgtgggctgccaagagcaaacaagatgaacccctcctctcctcaacatttcccctacctccatgacctatcacaaagacaaatgtgctatttgggggaaggaatgaaactgaataatacttagaagaaagcagtttcttggagcccatgtatcttcataaatatacactggcttttgatacatgccaaggcttacccatatcttttctgtggtatctcaagcttctaggggccccaaagtctccaaatgctccattccagatccccctatgcttctatttaaattatctggacgaccaactacatggcaagcctggttgaaataatagccaccctaattgtaaattaaagcaataagagaaacccctacagagtttcttgcttttttagtaaagggtttgcaggaaatggcattgaggatggtcataatataaaatggcaaccaagaaaagttggctgtgatggatttaggctgacaaagatgtacttggggattagtggtaacatatctggaattaaatgaagagagtttagtagataagaaagaagtgaggaacaaagatggccaaatttgccctgttgaactctgcaaagaactttggcctttagcttgtgcttcacatttttacgtgtgaggctaaaagcataaggccattgtaatagcaactgcgtatatatgctccaaatggcttgattaattttagatgtaagcaccatcagtattgatgtaaatcaacagtttataattcgttttattcttatgtaactagcttctttaaacatggtgaaaatttaatacatatatacaaagaaatataatcctattctcttcccattccccctcctattttcatgacaccttggccatatcttcaaagaatgagtctcccttcccagcagctaataactgccattagctttttaattaggggtggggctttaaattggggcaggtgttgtatgggaaaattaaatgcctagggttaaagcttcctagtagtcctgaccagtatacaactcaatttctttctcagatgtcctttaaaactgtgacaagttagactaacttatgctagccttatatgtagggaagtctgtagcaatagcagcgatttccccttaacaagaaggaatgatgtcttacaaaatttctagggaaatttccttcaggtcacaggagacaactgtattcataaaatattccaagtggatgtgggatgagatgtgtattaaatcaaccagctctacattgaattccctgtactgacatgtgagagataataaacaaatttgggggagttagattcttgtatgaccataaaataccatgaattctcaagagcataattcacactccaaatactcatgtgcagttccatatcctgggcctcaccctggaagccccacacactaagtgtcttctagctggaaggatgctgatgtaaagtcaacaatggccactccttaaaaacaaaatttatttagttataaactacctgcattagaacgtgtcaccaaaaatgttaagttaaatatgtttgataaacatcaataaaatgacttctgtaataagatatggagtgtcaccattgtgccttttgatttccataatgtgtttttccctccatctcctgttccctggccatgaatttgattagcattggttaattggtattttatagatttttatataaataaaataccacacaatgcattcttcctgactggcttttttcatttataggatgatttagaagttcacctgctagtcctgtatatcagtcattccttcctatttagactccatagttcactgtgttgttacattttgtttatccattcaactctaggcaatttcctggttgtgtccattttgaatgggctattctgaatgcttgtgtcatgtcttggcatgaacaaatgctttctttgaataaatcctgttttgtgcaagggttggaaatacagtatatattggtttactttggaataaactgttacagttttccagtgtgctgtgacaattttatattttcatcagcagtgaagttcagagttccctgtatttttgccaatacttcctgttatcagacttctaaaatttaaacaaagtaaagtaagtttgctgtctatcagtatgcttttattttacatttctctaatggccaatgatttttagtatcttacatacttgtcattcacaaaactttttatgtaacatatctgttctttcttatcactcacttgtcaatttttgattaaatattgttaactatggccagaatccacatgctttacagtgtagttgttttaagtatattgaaacttgcccaatgatctcatcaggttgttgaaatgaaatgtatttgaagagtctgtcttctatttttgactgtagtataaagtgttatgtataaggacatgtatagaaagaacagatattcacaaataaaatcagtacatgcattatcaacttctgtgactgccatatgtgtatataataaacatatatacatgcatgccatatacatataagtatcatacacatatatactttatctacacatataccacaaatatatatgatacacatgcataccatatatacatatcaaatcttgcaagtaggtagtattgttgggataatttccatgtttgatttttgtgtagattatctttcagttgctgagaaagcagtaaaattcctttttttctaacagagaccattatagaaagccacaatcaatcaaaacacagagttgtggatcccaatcccaaaggacatatctacattacaaccctcacatttaagtttcaggcaacactgcagaagagctggtagaaagatttttctgtggggtcaggatcccatgaccaagttctcagcacaaatgagtttatttgctccagaggagcaaagggcagggaatgagagacaaagattgcagacagaggatgaaggataaggggaagggaacaatgcaacatggccaggggtatttgtcctgcaagaaataaatgactgcctctgaagagagaggagatggacatggcccataggacaatggtggtttacaaggtaaaagggaaacctcatgttaggatgaagtgtttaattttgattggacacattaattaggtgagccaaagggggcttttgattgctgaacttcagcactttgatagctggatgctggtagtcagcctcaggactggaaagaggccaaataagggaatagaccttggtgaatagctttagaaatgtattctaatagttttttttttttttttatcaaggcagagggaatgcggaagaagggcaaggccttccagagtcttgtttgcactgcgtgagctgtctagagtcctctcaattatataagccagaggattaaagagttggttgtgagactgtgtgttggatgaatgtcagaagctacacccatgaagtctcaccaatatgactgcctaaatacgaactgaagaagaacaacaatagacatgccaaagtggatggggacaaggtcatgaggcctcagcactagacaaaaaactacagtcagctaaggaatgctgagagcaggaaaaatagtcttccctagggacaacaagtacatcaaagtacatcaattggttatccaattccaaatggtcagccttaaaaacatacatatagactgagcaggttaaatttaggagtgtgtgtgtgtgtgtgtgtgtgtgtgtgtgtgtgtgtgtaccagcaattagtgaaaaaaggggtcatgaacttgaaaaagagtgaggatggctatatgggagaatatgtacaacaatgtgcacatgtcttctgttgctaggccatttagtagactttcagcagnnnnnnnnnnnnnnntcagtgtggctctgtcttcctttcatcttctggatgtggatttggtgtttgagtattatgttgttaccctaccatcacccatgaacttactgaatccatcaggcattgtaatgctaccttgcatggtactgaggccaggttatattagagcatggcttgactttcatgagactggcttttttcaccatgcacacgatggagatgcatcccatcgtgaagcactactgtcttttattttctgctgtatggtaaatccttgagtagaattcataacccataataaaaattaatggaacctgcaaactctatccagacagaattgctgaagcctcagacccctttacaatgaaaagaagattaatttatcctgcataaagcctgtgtagaagaagggcagacaccagataaaaggatcaaggaaaacagaaatagtgaagccaagccacagtcacaaacaaactcaatgcctgcttgctacacaagtgcctaagctgtctattcagttgatataaaaaatattcatccatctccccataattgatagtgattttgtgtgggacatattgtttgaagtaaattttacagtgtcaattttcagctataggagtaacaagctagattgtaatagagatgttaaatggaaagcatccagaacgcctcgtcttaatagtggggtagaaaattacgtgatcttttagaagagtatagctttcatttttctaaggataattccactgtgtaagtggactcatttgttcaaaggtaattttcatgttagaataaggatatttaaggtaagaatcagaaggaatggtattcgttggacagtttcaattacatttgcttctttctgttatattctctgttttgagaatactagatctggtggatttggttggaggtgatgaacacctcttagagtggaaaccaaatgcagcataaaaaagtaacaaccaacaaaaaatgtacttattatctcacttccattttcagctaagaacaaacatgtaatcaagccttaacaagtcaacagcagccttctgactgcagaatcaagtgttaatgtcccacctacatagagggaaacaatttcccatatacatatagcgtacacatttacctataacatacatatacacacattaaatggcttcaccatgcaccccactacagagatgcatcctgtcttgaaacatcaccatttttatttttctacagtaaggtgaatgaaacctagggtggaatttataatccacaataaaaattaatgcaacctgcagcctttatccagatttatatacacatgtatgacactcgtgtagacatataaaacacatgcaacattcacacatttataaaataccataaataatacacacatatagacataataacatatgaaatggtgtgtacatacatacatatttacacataaatatatacaattacaatacatgagtaaatggagacacacatatacaaacaaaatatgaatgcattcccatataacacataaaattatacatgcacacacaaacataaacatatatacacttatctatagaaatgcctgcacacatgcatggtacacacacatacatacatgcacacaacacaaaaaaacaaccaacaaaataacaaatgaaacagcagcatggactctggtttcaagagacagtgcaaccagctcagtgtcagcagtgacacccagggttctgtgtggtggcagtcccattatccagaccttgatagaaagagaaacccatctgtgtcacatgctccatgtatttctcttcaattcccctcaatctggcagtcaatataagcttctttggggatttattatttgtttattggttgttgttgctgttttaccagatgtgacatttaaatgaaccaatcatcttgtataaatgcccctccatgttgagttccctgatctttgcatgtgatgaggtctgggttattcactggaatcttatagtctcaatgttatagataaggttaattttgataagcttctatctgcttattttcacttaactacctcgtggaggaatatttaagagcttatggctatcctttcataatccattttatccagttatttatgaaatttagtttggacaagtagatcctgaaattagttaccattatttcttgatcttataacataattacatcatttctcctttcctatccctttctccaaaccctttcctatacctcttcatctttcaaattcatggcctctttttcaaattgtttctaaacacacacacacacacacacacacacacatatgtaaacacacacacacacacacacacacacacacacacacacactcacacacacacagatgacatgattactgtctagaaaacttttgagacaaaaaacttagtatattagtagaaataatatggtaaatatatttaaatccaacttgtttaatgcatcatcagaaatcattggtttctcagggttttaacagattgccatttgctaaagggaaacatcgatcaggtatgaggagaaaaggtgaaatgtcccttttgaataatttatactactattctcctttattccaagattattatggtgattattaatttgtcagtcaagtaaaaattgttattcatgtttctttttagggtgtaaagtgcatcgctaattcataagcaggaaactacagtagtctgcctttccacctacacaatgtcaatgagatttcatttttggccttgcaaatggaaagcacagcttcactaattggtggatgaaatggcaattctgaaaccttaggtattcggtcaatctcttctcatttcacaaaaggtcaggaatatatacacacatgcaaatgtgtttttcacattgggaaaacagataggttaaagtgatagtgtagttagaaacttgcattttaataaaaagatactagtaaatatttcatatagcctgtgaacaataaccacattaacaggatttaaggcagtgattggtgccttcctaatctgttttattatctttaatgtaattgttcttggatgaatgagagttttagataaaaagcctcatgcattttaagtacctgtgtatgacaaattcaatttttgtttctactcttaaaatctgatttagttgacttttatgttgatatgcaatcttagtgtttacctgaaactaatcaatgatgaccttggtacatatttatagctaaaaagcaaccatctcaggacggggttatcaattctcaatattcatattgtttaaaatatcattcattaacatgggaattttaccaagtcattacacagtactataaatttatttcctgtgggaatttaatgctgcatgtttccacatgttatttctcaccccaaaaatcataactctagctaacaaatagtttggtatattaactccatgttgactgaccctcacattgctcagcctgagaactttccttacctcttcattcaggccttataatacatttcctagggatattgtataagggacagatgtgtaatcccaattctgtccttcaggcaagctgtttataccctaaagcatgaaatctgactattctttttatctgaacttccacatttgatatagtttctagggtccacagaattatccatgcctgagtggcagagcaagaggcatggaagccaggagagagagaatgcatgtcaatggctgactgagagagagagagagagagagagagagagagagagagagagagagagagagagaatcagtgcctgagtgagaggccaggaaacattgacaccagtggcctccagaaaatatcttaagaagagcctgtgggcatatcaggagacagcataagcacaggccctaacaggagacagaatcagtgcttcagcaggccagagtaacagccatggataccagaaaatattttaccactggagactcagcctcagccctgcctgcactggaggagtgaccactggagtcatggcccacctgcaatgacaaaagagaccacctaaaccttgagcctatctacacctggaggatggatcattgaaggctaagccctgtctgaatatgaaggagaattcaatggagccacaggcctccaactacaccaattggaagaagaatgacaccctgaagcacaggccccacctgtatggattggaggaagagatgggtggacaacaaggtattaatatactcaacaacacaaagcgcaatacagcaacaccagattccagtggttctacagcaacaagacctgaacatcccaactcatatgaagtagaagaaaatgacattaaaaatagctttatgaagatgattaaggcccttaaaaaggaaatgaaaaatttccttaaagaaatggaggaaaagacaaacaaaaattggaagagatgtcttaaagaaaaccaagaaaaagcaaccaaacaggtgaagaaaatggctcaagatttgaaaactgaaatagaggcaataaagaaaacacaaacagaggaattgaacctgggtaaatgatcaggaacaggagatgcatgtataaacaacagaatacaagagatgtaaaacagaatctcagccattaaaaaatacagtaaaggaaatagattcatcagtcaaagaaaatgttaaatccaacaaattcttaacacaaaatatccaggaaatctgggacaccatgtaaagaatgaacttaagaataataaggatagaagacgtatagcccaaagtcacagaagatatattaaacaaaatcataaaagaaaactttcccatcctaaagaaagagatacctatgaaagtacaagacgtttacagaataccaaagagactggaccaaaagtcccctcaccgtataataagtaaaactctaagcatacagaataaagaaagactagtaagagctggaaaggaattatgctaagtaacatataatggcagacctatcagaattacacatgacttctcaatggaaacaaagaaagaaaaaggtcctggacaggtgttatgcagacactaagacaccagggatgccagcctagactactatatccaacaatgctttcaatcactatagacagagaaagcaaggtattccatgacaaaagcagatttaaataatacatatccacaaatccagccctattgaaagtactagaaggaaaactccaacccaacagagttagttacatccacaaaaacacgggtaatacataatcccacaccatcaaatccctaaaaagggaaacacacatataatgccaccaccaaatacaaaaataacagaaacgagcaatcactggtcattattatcccttaatatctatggacttataaaaagacagagcctaacagattggatatggaatccattcttatgctgcatacaagaaccacacctcaactacaaagacagacattacctcaaaataaagggctgggaaaagattttccaatgaaatggacttaagagacaagctagtgtagctatcctaatatctaaccaaatagacatcaaaataaaattagtcaaaagagatggagaatgtcatttatatttgtaccttgaaaaatccaacatgatgaagtctcagtcctgaacacatatgccccatcgacgaaggcactctcatttgtaaaagaagcattactaaagcttacatcacacatcaagtcctacacactaatagtagaagactgatacactccagtctcaccactggacagatctcccagacagacacttaacagaaataaaggaactgacagatattattactcaaatggccttagcagacatctagagaatgttccaaccaaacacacaaaaaagataccttcttctcagtacccctggaactgtctctaaaactgaccacatactcagtcacaaagcaaatctcaacaggcacagagaaattggaataaccccctgtatcttactggagcaccatgacttaaagttagaatttaacaacaacactaattgcagaaatcccataaactcatggaaattgaacaatgctcctctgaatcaccactgggtcaagaaagaaataaagaaacaaatcaaacacttcctaaaatcacttcaatgaaaatgaccacccgacatacccaaacttatgggacacaatgaaagcagtgataagaggaaagttcatagcactaaacacctacataaagaagttggggaaatctcatactggctaattaacataacacctgaaagctctagaacaaaaagaagtgaactcacagcagaggaatagatggtggaaataatcaaatgtaggaccaaaatcaataaaatagaaaaagagaacaataaaaaggatcaatgtaacaaagagttgattctttgagaaaatcaaaaagatagacaaacccttatccaaactaatcaaaagacagagagaaaatatccacattaacaaaatcagaaagtaaatgagtaatatagcaacagacactgaggaaatccagagaatcatcagatcatacttaaaaagcctgtactccataaaattggaaaatttaaaagaaatggacagttttctggacaggttctccataccaaaaatcaaatcaagactagataaacaatttaaagagacctataacccctaatgaaatagaaacacatcaataatcttccaataaaaaaagcccaggaactgatggcttcatggcagaattctaccagaatttcaaagaagagctaactccaatagtcctcaatttgttccacacaagagaaactgaacaaatattaccaaactccttttatgaagctacagtgacactgatacccaaacaacacaaagaagtaacaaagaaagggaactacagatcaagttccataatgaacattgataaaaataatcaataaaattttggcaaacaaaatccgagaatacatgaaaaaattacccaacgtgaccaaataggcttcatcccagagatgcagggttggttcaacatatggaaatctgtcaatctaatctaccatataaacaaactgaaagacaaaaaaaaatgatcatctcattagatgctgaaaagccttcaacaaaatccaaaacccattcttgataaagtcttggagagatcagggatacaagaaacatatctaaacatgataaaagcaatatacagcaagctgacagccaacatcaaattaaacggagagaaactcaaagcaattccactaaaatcagaacaagacaaggcagtctactctctccatatctattcaatatagtgctcaaatttccagctagagtaataagataacaaaaagagatcaaagggatataaattggaaacaagaagtcaaactatcactatttgcagatgatacgaaagtataaatatgtggcccccaaaactctacttgggaactcctacagctgataaacaccttccttaatatgactggatacaagattaaccaaaacaacaacaacaacaaaacccaaatcaaaacaacaacaacaacaaacagtagctttcctatgtacaaatgacaaaaggcctgagaaagaaatcagagaaacatcatcctttacaataatataaaatatcttgggttaactctacccaaacaagggaaagtcctgtatgacaaaaacgtaattcccaaaagtaggaaattgaagaagatatcagaaaatggaaatatctttcatcctcttggataagtaggatcaacataataacattggcaatcctaccaaaatcaatctgcagattcaatgcaacccccatcaaaaacccaacacaattattcacagaccttgaaataataaaacttaatttcagatggaaaaacaaaaaatccagaatagctaaaacaatcttgtacaataaaggaaccactggaggcatcactgtcctcaacttcaaaatctactatacagctgtggtaactaaaacatcttggtaatggcacaaaaacagacaggtggatcaaagtaatagaatcaaagtccctgacattagtccacatacctatgaacaactgatttttgacaaagaaaccaaaatggtacaatgggaaaaggaaaacatcttacaaatggtgctggcataactggttgtggttgtcaacatgtagaagaatgaaaatagatccatatctattatcatgtccaaaactcaaatccaagtggaccaaggacctcaacataaatcccactacattgaaactggcagaagaaaagtgggaagtagtgttgaatgcattggcacaggagaccacttcctaaatagaataccattagcacagacactgaaagcaactatcaataaatggaacattctgaaactgagaagtttttgtaaggcaaaggacacagtcaacaagacaaaatgacagcttacagaatgggaaaatatcttcaccaaccctgtatctgacagacggctgttctctaaaatatagtccaagaaactagacatcaaaatacaaaataacccaattgaaaaatggggtacagagttaaacagaggattgtagagtaagctgtagccacctacttaggggctggctgacactcgggccaaagcttcggatactgacttcaatcaagttaaggatttcaagtgagatcttctattaagagaatcccatctaacatggactggatacaatccactcaagacttttactacactaacattttcctcctacatgaccccatgaggccatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacctctttcagatgactttagggtttagttaaaataggatgtgacataagaagattgttgtatcttctgatattttacctttatgattgttaattttggatactttacactgttaagttttaatcctcttttagactaaaaggggaattgtaggggaagctgtagccatgcctacttaggggctggctacaggtgtgcctgaccctgcttgcgagggcgtggtcagggtgatgtagagtgactgcgttttctctttcggtttcactttggtatttgttagacagactgctgccacgccggctggctaggtcgctctgtaagtaaggcttttccctattaaatacccttatatttctacctgactctgtattggtaatttcccactacagaggattttcaccagaagaatttcaaatgatcaaatggcatttaaggaagtgctcaaatcattaatcaccaaggaaagcaaatcaaaatgactctgagatactatcttattcctgccagaatagctaagataaaaaatcctgaggacagcttatgctggagaggatgtggagtcaggagaacactactccactgctgatgggagtgcaaacttgtgccactttggaaatcagtatgatggtttctaagaaaatggagaatcagtctacctcaacacccagaaacaccactcttgggcatataaccaacggacactcaatcatacctcaaggacacttgctaaacaatgttcatagcagcattattcctaatattaagaacctgggaacaacctagatggccctcaaccaaagaatggagtacatttatacaatggttgggagacttttaatgactgcttctatgagaaatcaggcagtagggaaatgtccagaaatctacaaggatgacaccaactaactgttaaagtgaaaaaggagaggttactttaaatgtcctcccctgctagtgagattgatgactaacttatatgccatctcagagcctttatccaccagctgatggaagtagaagcagacagccacagctaaacaccaaactgtactggaatccagttgcagagaatgaaaagtgatgagcaaagggttcaagaccaggctggtgaaacccacagaaacatctgacctgaacaaggggaaagctcttagcccccagactgatagctgggaaaccagtattggactgatccagaccccatgagtatggatgttagtagggaggcctcagaaatctacagggcctcttgtagtagatcagtacttatccctagcacaggaatggactttaggagcccatcccacatagaaggatactccctcaggctagacacacaggggagagcctaggccctatctcaaagggtatgacagactctgaagacctgcctgtggaagacctcactctccctggggatcagaattggtatgggataagtagggtgttagtgggaggcaggggagggggggagggagagggaactgggattgacatgtaatacaatcttgtttctaatgttaataagaaaatggagggaaaaaatgagtaactatgtaaaacagccaaaaaaatttacccattggattactactaagcagtaaaaagtgatggcctcataaaatttgcaagcaaatggatggaactagaaaaaaccatcctgagtgagcaacccagactcagaaaggtaaacatagtatgtattcactcataagtggatattagatgtaaagtaaaggataactagaatactataacccacagctccagagaagataggtcatgagtagtaccctaataagggatacatagatcaccatgggaatggaaattagatgagatctactgggtaaactgggagtcaggagtggtatgggagaggtgagggtggatgagaacatgagggaacaggagatggacaggggagagatgcagtggaagagcaatgaaagagatatcttaatagagatagccactattaggttagggagaaaactggtgctagtgtaattcccaagaatccacaaagaggtccccagctgagactcctagcaatggatacctgaactggccttcccctataatcataatggtgaatactccaactatcatcatagaacattcaataggtaattgaaggaaacagatacagatatcaacagccaagatccaggcctagctctgggaatccagttaaaaagagagaggggagagaatatatgagtaagagatgtcaagatcatgttggagaaatctacagagacagctgcatcaaactcttggaaactcatgcactctcaactgacaatggtagagacttcagggaactgaactaagccttccatatgtgggagacagttgtaaagcttggactatctgaggcagcctgccaagtaggaccatgatacaaaccaggtacataagctagcttgttggatcccatttggtattgtaggatgccaccctcagccttaatgcatgggagaggggcttggccctgctccaacctattgtattagactttgttgactcctcatgagagtccttactggtgagaagtagactgagggtaggctggatggggaggtgggggaggaagggaggaggtgtgggaggaagaactgtggttgaaatgtaaaatgaaatttaaaagaataaagtataaaaaaacaatctaaggcattattgcattactttaaaggataattacttgaaactatttctttatggcattgccatccctatatccatatacccctccacttttccttattcttttttctttcattagttcaaattaggaacaagcttgctttacatgtcaatcccttctatctctaccttctctccccccaaccaccaccagcccctcaacccatccctcctctgctccccagggagggaaatgctctccatgggggctccccaaagtccacctcatcatcctggtctgggcctgggcctgtatgttttgcctgcatgtgtcaacaatgtgtgtgctgtgcccatggaagaagaaaaagggtgtcaaatgccctgggactggagttacaggttgttgagagccaccatttgtctgctgaagactgaattcaagttctctgtagaagcagcaagtgctattatatctccagcccaccctatcccttattcttgaggatttagagtatgttaatacagtgtcaacatcaaagggcagatatatgactggtagcatgctgcaaaaaaacctgggtttgatactcagtactgaataaattgggcatgatggagcatgcctgtgatccaagcacttggaaggcaggactggttggtcaaaggcatcctcagctgcataatacttcaaatctggcctgtgctactttagacccctcctctctttccccccataaaaagtctcatcaaatttttgacaaataaataaaaatgaacataacctagcacctgataaatccacattctaaaggaggtataggtaaaacaaaacatagtaaaaataagaaagtgaaaattttcaattattttataaagaaaaagaaaccagaggtaatcactgaagttagtttcaagtagtatcccaaaacggagaagtagccttcacttttgttattcccttcacttttgttattcattccgttctgtgactgtgagctctggcctctttcctttccacctgatcaggctcttcagtagagagtgaaggaattttttaagggcaaactacctcatcccccttcctgtgttcctctttcagggaagtgcactttatggtattgaacacttcagggttttagtgtttagagcggaggcccctccccatcaaaacctgcttttccaaccttcccttctataaccccactacccagagatgccatctggttggagagggaaggtttctctgaggcttacctcttgcccaccatgttagagtcagctttcctcccctcttgggagacagctgctcctgctgggcttaggaaacattccaaacttgcatgcaagcataaccttacagaccagagcttgcaaatatgggttgtgtttcaaatttggttcagaggctgcttatatttttaaaggttgtataaaaaacaaagacagattcatagcagagaccttgcatggcttgcttgcaaattctaaaatatttactgtccagcccctcatgaaaagtgctgcagtctctggaaatggaacatgggtccagtaacttaaaaatttaaatgcttaataaatttttggaagaatggaatatatatggataaattaggcttctgttgatctaaggcaggtgactgttgtgttggtgctgttaagtatggactgtacatacagggttttggctttatagattttagaaactgatatccactgccatggccaagttttgcagatatgtacttagcttctatctctggaaaagagctaaacatggcttagattccatgtctcttgttatgttttaaaggccagctctgtttattctaggcctttctcctttttcattgtatatatatattcatcagtgcctcagatttcagtaaaattctcagttctctgaagtagtaggttttaaaaatgtctgtgggtacaaaggtatcacatcacagaggcctagcttgtgctttaggggaactacaggccccaaaatgttagtaatcccaaaggccccagtaaagttgtgacatacattgcaaacagacactgccctaggcaaaagggtgcattaatacccagatgagggtattgcttcagggtactgatgttgcagctggacttttgtcatatgggtcatatttgaacctcatggcagtgttgttgacagggccatgaaggcttcaggaggcaggttcatccaaggtaattaattattcacatctgagggtatttcttcctatggcctctgcgatataaggctactgaatactatttgctacttttccactagtaactgtatttcacagtcatatttgtaattagatagaccaaatacagcctaaattttaccaggtgtggtgtgagggtctgaaattaaagtgttgctccaagacctatgaatatgctgttccttacttacaagttcattgttccttgtgtcttttcttaattcaggtcataaccagagctgagaagagataattcacctttagttcatgtcagttttccacaattcaaaacccataatatcatgttggcattaaaattgagaatatcaatccaagaaaaagttctaagactctcaaacctacaagatagaatgacccaggagcactgaacaccagatgctttctcctaggaaactgtagattatgttccaatacagaagtcacagtcaagtcagacaatgctgcctatcttgtttaggtttttattgctgtgataaaaaacaccatagccagagcaactttggaaggaaagggcttatttgagtttccacgtagcaatcacagtcctttattaagggaaatcagggcaggaactcaaggcaggaacttggagccaggaactgaaagcatggaggagggctattactgaattactctttatggctttcttagcctgccttcttatagcatccaggacctccaatgcagagtggtggcccacaatgagttggacactcttagatcagtcattcatcaagaaaaagctttttgctttcaaaattactctagcttatgtcgaattgatataaaactaccaggcacactaccaaatactcctgaaagacaaaatggaaattaagatgtctggaatatactggctgagaaagaaatgtgtttgactaagttgtgattgaagctgctaataattgcaaagttgtgaagttcataagaatgaaattagtgtattcaattcacagccttcaaccacacttactctaaaattaaactttgacgataatttgactttcagttcccagattattgatctggacagcagcacactgctgaggcagaaaccaagagcatctccacctagcacactaatctttcttcttctccttcctcttcattctttcttctcattctccctttcccttgtcctcctccttctctacctctcccaattcctttctttctgtctctctccattcctcctccatgaacaccttgcctctctcttgctaagattgcactgattttttttttttaagtcttggcaatagtgcaccccagaatcacagaataatactctatatggggtgattattccaggattttgggatttctgcccaccctactattttgtaactacatggaaaaggacacactgtccacgtgcttgcaactcagtaccagaaaaatcagatttgttaaacatgcagacccttttcttccatgggtaaaactgggagcaattcacctggatggctgcagtcgatgctgtttgataacctggagatattttgctagcttatggagccagccatcaccaaaatccctagagtcatgagcattgtttcttagtcaatagacttattctcatgaaagaggtcctatgtatttgtaaaagagttttctagcaagtggtcttgcggaggagacctgggggagatagaaggtaggacataggcaaaatgaaagtaaggggaacacagggtagacagtctgaatggaggaattgagggtggggagaggacaaagaaagagctaactaaatttttttctaaagaaaattcagtgatctttgagagagtttgtaatcccccaaaacatacaattaatttagcttcactgctaaacttctgaataataaaaggaacaggcatagtttctggttctcagaagacttactaaataatgattgatgatattgagggatgcttaagaaagtctttaataaagaataatctctgctatgtttcttcacaagcatgggtgctaatactgcaatgattcgtttgccctcctctttggcacctgtccccctcactgaattacattttccagcactgttgtaagagtacaaattttccaaggggaatgaaaatacatttatatttaacttagtttttaaattctagggtgaatcctaacaacaaaggaaaagaaacacttagcactggaaccgcatctaatgtatcagctgtggtaagccatcttcagagttggatagaaatggtcctcactaacacttttaacattggcaagaaaccacttgaatcagagcacaggctagttcacattttcaaagagaatctatttccagtcagaatcagcctttccccctgacaatgtgcaattaccttccacttatccaactgccattatcaactggatcacatagcccaatcccctggcatttaaatcaatttcaagcccctcacaatttctcatgatttaattaaatacaaaagcctagtatcagtaagttactcttttctatattttcaatatagtaacaatatttgtactactttgtatacattatggaagaagccctttttggtaaatctaccaatcacttactaatttttcagagatgaaatattaaactgtcaaagcaactggctaccccaaatcatattgcaataaaaaagtttcaatgttcactaaattaatttctcaacttaaaaaaatagtcttagttttggctccccattttgttggtggtcatttatcatctcaagcaattataaaagtaccctttactcatttttaaaatgtatgtcttaaaatatagatgtaacactttattaaatgtctctaatagaatattttgtaataatttaatatgttattaaaccaaaacgtcatgaaaaaatcctaaatgttgggctggagagatggttcagtagataaaactcctcttgtataagatgagaacctaaattcaaatcagtggcatccatgtattaaatcaggcaagtctgttggtacctgtaacctgtgtgttggaggatagagacaagagtatcctgggttctcactggacagatagcctagccaaaattgaacatattcagtgaaaggccctgtctcaagagaaccagatgaagagtgatataggagagcaactgacatcctcctctggcctatgcaaaaatataaatggattcatgtgaatacatgcatatgtgtgcacatactgacaatgtattattagtaacaataacaaaaaataagttcatggggctaaaagcataactcagtggaagaatgtgtacccagcattataaagatcttgtgttttgcaatttatatacatataaatacattgacataaaatgacatttatgacaaacagaatttaaataacaattaattttcttgcagcagaccacagattgagaaaagatattcaccaaccccatattcaccagagggctgatctccaaaatttacaaagaactcaagaagctagtttccaaaacaccaaataacccaattaaaatgtagggtacagaattaaatagacaattctcaatagaggaatgtaaaatgtctgaaaggcacataagaaagtgttcaacgtccttagccatcagggaaatgtaaaacaaaacaactctgggatactatcttattcctgccagaatggctaaaatcaaaaacagcaatgacattttgtgctggagaggatgtggagaaaagggaacactccttcactgctggtggcagtgccaagttgtacagccactttggaaatcaatatggcgatgcctcaggaaaatgggaatcagtttaccacaagatccagcaattccactcttaggcatataccccaaatcagcacattcatacaacaaggacatatatctgttcaaagatattcatcgcagaataatttgtaatagccagaacctggaagcaacctagataccccttaactgaagaatggatagagtaaatgtggtacaattacacaatggaatactactccgaggaaaaaaaacaatggaattttgaaattctcaggcaaatggatggaactagaagaaaccattatgaacgaggtaacccagtcacaaaaagacaaacatggtaggtactcatgcatatatggattttagacatagaggaaaggattaccaacctacaatccatactgccagagaagctgggaaacaaggaggactctaaaagagacatacatggtctcccagagaagtggaaagggacaagatctcctgagcaaattgggagcatggggaagcggagaaggagctaggagaatgagaagaggagaagaggaggacgtgagagagcaggaaggttgagttggtggaataatagaagagagcaagataagagataccataatagagggaggcattatagctttaaagagaaatcaggcactagggaaatctctggagatctactaagatgacaccaactcacaatctaagcaacagaggagaggctacctaaatgcccttccatgacaatgagattgatgactaacttatatgctatcctatagccttcatcctgcatctggtggaagtagaagcagacagccacagctaaaccctgaactgaactggaatccagttgcagaggaggactgatgagaaaaggggtccataccaggctggtgaaacccacataaacagctgaccttaacaagggggaactcttggttcccagactgatatctgggaaaccagcatgggacagatccagaccccatgaacatgggtatcagtgaggagaccttggaaacctatggggccccttggcatatatcccaaatcagtacttatccctagtacaggagtggactttgggagtccatcctacatagagatggatactccctgagcccagacacatgggagtgggcctaggccctattccaaaggatatgacagaatttgaagaacccctatggaaggccacacccatagcttcctggccttacagtctttttcctccttcttccctaatgggcttggagagatgtgtataatataactgtaccatttaaggctgatcattctatagtatctcattctcttcaacttgtccagttttgggtctctgtgctaaccattaccctactgcaaatagagacatctctgaagagggttgagagatgcatttgcatatggatattgtgattaagtcagtgagaatcaattaaatactatatttagcagaataatagtagtaggttcttccttggtgcatatgacctgtttagccatagattcttgaattgaaaatggtgtcagttatggcttttatcttgtggagtgttatttagatccattgaagaagtatttggttacttgcatgatgtttctgccactattacaccagtgaacatgtattttcaggtcagtcatttttgtagtttgcaggtttcacatctgggtaagactgtggattacttttctcctctggcaacatgtataagatcttctaacactataaaatctagtcagtagataaagaatatcatccaaaaagtctttatgttcctctaataaacaggttggtatacctttctccttctccttctttccccttttcagtaaagaattacatttgcagacatatacaataagacacaacaaattagcctcgtggtggtggtgcatacttttaattccagcatttagtaggcagagacaggtggatttctataagtttgaggccagccttgtctgcagagtgagtagtaagtaggacaggctccaaagctacagagaaaccctgtcttgaaaaacaaaacaaaagacacaacaaatcctttcattaaatttgctatatatttactgaaaggcacgttgtaaatctgatgtagtctgtaaacagaaattaattcaaatataaataccaacgtaacattttgagtagaaattagttttgtccaaatcctgggacttcagatttagcttttttagctttggaaagtgtcatgaaatctattcaatttctttcaacttggtcagcaagccaaaccacacttaagtctgtcagaaaaagtttgctttattttttcagttcaataaatatgttaacattcttccctacaacagccatcttgcttctgagtttgaagattgttatagaatgcaaccctgacaagttttgtttctatgtaaaataagatatgccaccttcaatatttcttactgataacaatttctttgtctgcatgaatctcagtatcaaaaaatcactgcatttttaacacggtagtatactagaatatgttagcacatcaaatgaaaatatttaattggctcaactacactgcaatgttgctgtgtactggagttttgcagatgagaacataaaaaaagacacaaggggtattagaagatatgatgatttattaaaacattgaaagatgatcatcagacttcaattgttctctttgcttggctcttgaaagttctcaaaagcaattcagtgtaagacagagataaagcagaaggagggcagtttgagctgtactgacattagtagtacaacaaatatttaacaaatgactctgaaaaaaatgcatggtatgtatatattcattgatttcttatgagggtgatggacacgttgcccagtgattaagtgctcttagggttttctgactagtttcagtcaacttgatacatgctgtagtcatctgagaagacagaatctcacactgaaaaaatgccatatcagattggcccgtagacaaattttggagcatttttcttgattgatatttgatgtgggagggcccagactactgtgtgtgttatcatccctaagcagtcaatcatgggttgtataagagcaaactgagaaagctgggaggaccaagccttagcagaattccttcatggtctttacttcagtccttgtctccaggttcttgtctggagttcctggcctaatttccccaaatggcagactgtaatctgtaagctgaaataaatcctttcctctctaagatgattttggtcatgtaatacagaagcaaatcaatacagaaattggtaccaagagttgggtatggctgtgaccatctgttttcaggaggattgtgcaatgagcttgtaacttagggttagaaaatacattgattgttcagagcttgatgagttgtggaaacctggaatataggaatggtgagagcaatgcagatgatgtaggtctggtatgtgaagtttcatagggaagtctttgggttcttcaagggttctgttagggctgctcatgtgatattttgaattgagaacatatggtttctggtcatcagtgattgaggtatcagctgtgattaagaaaagactagcaccactgaaatgaaagttttcctgggacaattaatgctggttatctggggttgagaaattatctgtaattaaaagagggcatcaacactgaggtgaaacattcctggagtttccccagggttaacaaacagatgctgtggtccagagggatccaagtctccatcttgtgctgacctccaacgtggtgatatatatttatgatttataaaagcttgcctgagggtacagaaagcaaacctagccacaagctatagagtcaggcagtggtgatataaaactttaatctcagcagccatgtagctaggcaatggtgccaaacacttttactcccagtactcaggaattaagggcagacagatatctgttagttcaaggccatactgagataccagaaatcgatccagttctaaagagaaacaactcacacagtggtcatcttacttgggatcacatgcctttaatcctaagttgacaggtataaaaagaagaagcaaagtcaatctagaagatttatttatttatttatttgtttatttatttatttattttccaaccatgttatggcataatatactccagatattggtgttgacacaagccaccaatctattcaacctttcactttgctgacacttataaacacataagtttatagttctttatcatatataggtttatgcatgagccctccaccactagcaagatatattttaaccatcccaataatcaagcaatgcacccttctaataccaggtcatcttcgttcttacctccccatcttatttctggcctcttgtcctgagaactaccagtctttatttaaaaattataatttgaagattttagataaactcaatcactcattatataactttttaggattgacttctttcatttagtataatgattggaaagccatcttaaatatttacatgcatcaaatttaatgataatttaaacttaggcatagtgacacatccctgaaattccagcatgaaggtgaagcaactaaataatgaattcaagcccagccttggctacagagaaaattcaaggcaatctagagaatgtatggagatcacctcaaaagtcaatgtatgtacaaaaggatttatgtgcacacctgtgtcagtttctttctttgtttacttttttggtgctgtatgatatatatgaatatatattttttgcatcattactgctgaagtacatgtagactgattctagtgtttggcatttgcagagaagttacttaacacaaatatacaggggatatttttgtgtgtaaatataaacattgtgtgtctggaatacacgataaagaatataaccaacaggcgcaacggtaaggtgtgtctgcatctattattttataatttaattgagtgttactggtgaatcttaagagttgaatatatgtaaattctacgtaatttttcctttgtaggatatgtgatttcctaagattttcttcgtagttttaaaacatttcctcatcctgccaataggaacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttctgacactagatgaaagaaattgtaacaggacatggaataagaatgacattagttatttattgtgagagactacttacaccaaaacccaggttagtctctgaaagccttttgagaccccaccagaaccctggaagtgggagcgagcctcctccttcccagctctttttcccacaccttctatgtattccactgcaggtacatgggatctctccctacatttgagcatacactgtgtgtacactcttcacctaccctttctgtgttcccactacttccttcaccagttttgcttcttctgtgttgtgtcttttgtctgaagtaaaatatccccatcacaaagttggattgtagcataatttataaaatcccagacaccattattggggttcaagcttcaagctgcagatcagggaatcaaagcagctggccactagctcttacctctacttcaggctgaaaaggtgattcagctagctccacgattcctcagtctgcaatcatagactgctgccttcctatgtatgttacagtattgctaaagattcataatattcaacaaattaaaatctgctagatttagtagtagaagagtgttaagagcagacagactggagaatccacagccttttcctttgggagacataaacgtaaatataaaaggaaaaatgcaatagctggacttgtgacagaaactgcaaaatcctaaggaccaacttaacaagcagggtataagacctatcagaaattggatgatgagcatgaaaaggacccaaattaatagacatatatcttgtgtccttgactggagtggaattctgaattgatagagagacttttaacctattggattcgaagatcaaatttataaaaaataaaataaataaaattcaatttttccaatactaggctactgggtttgactggtgtttccaggagacattttatgtaatttaattttattattcattcaagagataaactttagccaaagatattttgaaaagaatattaaagggatatgccctacacattttcagcattttaacaatatggtcctacatatatccaacatgcatcaactgctatgctttaataattgcttcaatataataagatgtataaacattttatgcaactcattctgtaagagttacatgactataattctaatcctagatcaggtgaagtaaatagtaattaaatgacagtgatactaactcaaagacacacataccaatacatggaatctctatattaaagagtgtggctctttatactaggaggagcactgctgagaaatgaatgtgatgaaagtcctttccccaacttcacacttatattttaataatgcaggccaggtgatggtggcacattcctttaatcccagcacttgggagtgagaggcaggttgaggttaacctagtctacagaaagacttctaggacagccagaactgttaaagaaaccaagtctcagaaaaacaaaacaaaacaaatcaaacaaattaaaaaagcaacactttgaacagccatttagtgcattctacacacacacacacacacacacacacacacacacacacacacacactctgtatgaagcagcaaagaaacaaagggcattattttgaaagagtgcaagggagatacatgagatgctttgaagagatgaaagggcaggggtaaatgatatagtctcaaaaatacaattttttaaaaaaatataatgcatattagatagtgtttttacaaagtatagggggaaagttttataactgtggttataggagaggaggtgttttgtaactctgttttcaaggaaactggtagaggtgtctttatagaagatttaccatcttcccagtaaacaaccttaacatacaaaagacacatgtttcaggaacaattgttatttgcattatgtgttgcagatagaggattatgttattgttggctttgatttttgttcaattttgtttctgtatttctatcgagaattcgcagtatgttatttggaaagtgaagataaaacaaattgttaaagcaagataatgacagccttgattatggagtaattaaatattttataaataaaaatatgaaacaatggaatgatatacatacataccagaagtgacaataaaacggtattgttcaaatcagatagcctcatgtaaaacaacagtataatcttatctcttaccctgaacaaaggtcaactctaaatggatcaaggatagcaaagaaagggagctgcttgaacttttatatgtgcaggaaaagtctttctgagcaggactcacatagcccaggcattaagatcaacaataaataagtgtgacattcttctgcctgaggtacttccaagtgcattgagagttgggcaagacctggaagtccttgtacatactgatttcctcttcctgttacctttattccatgttgtttgctacttcctttatctcccatggcttctacttctagccagtgttgctcctactatgaagacccacgaggccatagcagcattcctccctgcccagaattgtcttgggtctggtttattttgttcatgggcaattccatcactgcacttagattctgtgatcattttttgcttgtttaatcaaatccacaatacagaccaaaagaaagagtttgttggaaggttgggcacagtagtatatcctacgggctgtcatgccctccccccaaactttagtagtttctctggagccgcttgggctacagcaacttcttagctttttcagtcaagttttggagcctattcattcaccaccagtttgctccttatgcatttcacattgctttgtttccactaaggctgacctttgtagatggcatgcttaccagatgatgagaggttagagactttcagggttcttagtttatgtttgctttcccctgggttgaaactcagttttgaagctcttttccaaatcttccaaagctataagtgtcaccggcttctggaaaaggcccctgccttgtacccctgagacaaagcctcaaatgtcagccttggcacatagagtactcagttatccctgtggcttttccttactgttacccatgcttttctttataaaggctttcttagccactgtctatagtacactggcccttttatctagccaggacttaaatgcagctgcaatggatgaggcttcagcatgacctcttttgaagtatatcaacaaaggcaatgagaacactaggcctcctttatgcattttgaatctcttttctattcaagacaagctatattcactaaatacgtagtacaatgtaaataacacaataaaccactaatcactacaattattgaaatactagacattgaatcctacttcagcctttggttaaataaaaaatagtatttcagtattgatatcaatgctgataaaaatgggcactaaatttcattgttcatacttagaaattggtattaactaaactgaatacgcttcctggtttattcatagtctataatagtacactctcattctacttcttttaaattattttgttttcttctagacacaaagccagatcttgtatgtgtcttttctcaataaattgtaattccttatcgggaatgcttgtcagtgtactctgtccattgtacatgttcaattgatgatgcacttagcaacctgaataatgagcaaagtgaggtaattgaagatgtgtagctaaatgtaactggctcttgcctccttaacatcatacatatccatttaacaaatatatattaagcatctactatgtgccagacaatggtttatattcaaagttttcatgcaggaaagtttatgttgaaatgaagccaaggtgcttttcatagaaaataaatcaaaataaagcaaaaatctgtataagagttaccatcccctgccttttcagagcatatccaagctcactctgattatacggttactatggaaaagtgcattccaagtagtaaccaacttttaagtgtatgcttggctttcagtctgtttaaattgaaagctgtttccccatgaccccttttaacatcttgaagaagatgctatggcagcttataaatctaagttaacaatcagaactataagaaaggtaatttaatccttgctttaaatcatttttgtcatttctctttccttgcaaatcataaaggcaaaacaattgaaagcctagagattaattatagactatgctaccaaacaagtcttaatacttttcttaaatttgaaatcagataggcataattacattaaatggtacttacccaggagcaaagcagaagctactataagggttccaccaattgaattgctttggggggagctgatggacctcagtaggtgatagaaagtactgacagtgatgatgtcacccattatcacacagaaggagagcctccatcctcagagatgctgaccatctgtcttgaaatatgttcaaccattctcctataatacaaaaatctccttctacagcccctaatttggtgactgtgtccatttttacatttagctccattgttacaatttctgtgatcataaaatgagtcagttaccaactcttagcagatacctcatgacagaatattttaaacgttattcttggcatttaactataacaatgcatttgtattttgtttttgactcttttatttatactttcctatgttttaaatgttggtcttgtgtaaatctgagctagtttctttcatccagtctactagtttcttcttctaagggttaggaagacagatgaagaactttaatcactgtgttcctagaagataagcagcagagaagtctaatgtccttttccactttggaaaaccacatctccaaaggaaatggcatacacagccattcctaccttctgtcagtttgaagccctatctgccatcctgttggggacacaattcttgaaataagtcttattttcagatccacagtgtgtgttgtttcttgagacctgaatacagaacaactgttatgatgggatttatccttcctgtgtttgtggtagaaatatagcctctgtctctgaaagtggttcctctgacctgagcttccaaactcatcttggaaaccctatactttggggggactctaaattcaaaattagtccttagttttagaattcctgagctcaaaatgtccataactgattgatttttatattgcttctgagcatgttttgttctgaccagacacctaaaaatatcagaaaatgcactttggaacatggttaatattttgatttataaatatttgaattagcaagtataactttgaaaataaccaatgcatctgcttatttggcattaaaactgaccataaaatcctctataatagagtacttatagtcttccaaactgtttcagcctagtctgctgtctgtccccagtatttagcacagtttggataaaattaactcaatcctgaccgtcaatcccatgattcctaataaacaattacttcagttctgggcatattcagtgtaaatacagaatgggaggtattctcctaaccatagaggtttctcagttatcctgtgctttgacccttgtgttcatttaggaagtaaatataatttctcaattttgtataggaacaacatcctgtgtacatttactattatgtaaacttcataaattggttacacagtgaactgggccccaactagttacaaagcatatagcaaacaaccttgaacagaagacctaattaaaccatggtttctgctgctggaatctcctgacattgtctctgttgccatgtacagctagttgggacacagtagacataataatagaaattagataaacacagaattccaaaataaaggaattatttctttgagcaaacaattttgtaataatggcactacaatgatgctaatgttattaaagttgatatttttaatttctttcttttcaatttatctccagaaaataaagttgaggatatagagcagcagctgaaattcctctcactctcctacctcagcctctgtggtgctgggatgcagtcattgcatgggatatatgcttcccaagtgtattctgtaagtggcaattagatgttaccagagattggtttccagatctgattgtctttttagttagtcataaatcctggggcattgtctatgaaatacaaagttgttctatgaggcctgaccaagctgtcaatatatgcaaggcagcttgagcaggaataagaaaaggcagagcaaacaaatcacatggttaacagaaaaaaatatatttcttttcttacagacttaaaacgaagtaaactcccttacaaaaccactggattggtggctgtccatctcctagtttggagaaaatcattttgattgtgtggctttttaccaaatcattcctttctgatttggtttgatctagccagcttagtacaggagcccagttcaaaatgatgggctcttgaaaacttatttagcaacatgctatattttgattagtggtctccagtggaattttatccactgtgctctggttttcactgacactaacatcactgaggacttttgagcctcacttccttctgacacatgactttttaagaaaactgaaaggtggcaatatttgttttaatttccgtatcttgactatgttttgtttccatctcagtgacttttaacaacattttcctgagaaagtctattttttccatctccaagactctattctccatgtccatgtgctcttcctgtgcatacctgtgaatgtcttgcggctgctttctgtgtcttcaggcagtttcttctttaattacacctttgtactcaagatcatagcacttttaactttgtacaatttgctgctttctccttctggttgcctccagcatgccatgcattggtttagctggtgttatatctctaccggtccctatttactctgtatattctatgacatcagaagcttcacagatttttttcttagctctgtcatacactttcactttatatttgatagttatatcaccttcgtttttagctatacgtccttaacttctaaaagataattgaatttattaaattacttgaccagttggcatattgggtaaagacacccaccaccaagtctaacaatctgagtcgtatccccaggacctacatggtaggaagggagaatggagtccagaaagttgtcctctgacctccacattcatgccatgactcatgtatgagcatgtgtgcacagacaagaaacaaaaatgaaaatgaataatcctagatacagaataaagcactgttgtattaaacattcagcacaatttagttcttccctgcatctatacaatcttacacatatcttttcatctgggtcatgaaaaacttaaataaccccattcttgttttgttgtcacaaagacagtgtgagttcattcttttggatgagtttttgacatttatgatggcttagtgacattttagtaaatgttccctctctgtgatattcctggctgtcatcttgactacatctggaattatcttaaactcaagcagctgggcacacttgtggagggatctttcttttttttttccccttttttattagaaagaaaattattttacatgtcaatcccaggtccccctccctccccttcatcccctgtctccccaccccaactaacaccctaactatcacataccatttctgcttgccagggagtgtgaggtcttcaaagtctgtcatattctttgggatagggcctaggccaaccgccttgtgtcttggctcagggagtatccctccatgtaggatgggctcctaaagtccattcctatggtattgataagtactgatccactataagaggccccataaatttctgaggtctcttcactgacacccacattcagggggtctggatcactcccatactggtttcccagctatcagtctggggacaagagtttttccttgttcaggtcagctttttctgtgggtttcaccagcctggtgtggacccctttgctcatcagtcctccttctctgcatctggatttcagtgcagttcaaggtttagctgtggctgtctgcttctacttccaccagctgctggatgaaggctatacaatggcatatgaattagtcatcaatctcattatcaggagagggcatttaaagtagcctctcctctgttgcttagattgttatttggtgtcatctttgtaactctccagacatttcccttgtgcctgatttttctttgaacttataatgactccctctattatattatcttttatcttgctctcttctgttcttcccccaactcaacctccccatcccatcatgtcttcctcacccctagtcttcttacctgctcattctcctagttccctctcccctcctccatgctcccaatttgctcaggagatcttgtccctttcccttctccagggggaccatgtatgtctctcttagggtcttccttgtttaccagcctctccggcagcctgggctgcaggccggtaatcctttactctatgtctaaaatccacatatgagtgagtacatacaatgcccgtctttttgtgactaggttacctcgctcagaaaggtttcttcgagttccatccatttgcctgaagatttcgagattccattgctttttttatcccccctctgagtagtactccattgtataaatgtatgacattttctctagccattcttcagttgaggtcatctaggttgtttccaggttttggctattacaaataatgctgctatgaacatagttgaacacatgcccttgttgtatgaatgtgcttcttttgggtatatgcctaagagtggaattaaatactttaaagtggaaagacctccctccctgaatccaggtcttttgagctgagaagatccacgttaaatctgagccatactttctgctagaagcctgtataaagggaagaagaagacggaagttcttgctctttctatttttgccctcactcctgatgacaagttcattgcttcactggaattaaagtctacattttcagaattctggaatatactgaagaccagagaagaccagataagtgtggactgaatgtttcctggatacatgtactgtctgttggtagatagacattgttatattggactacagcttgtaagccactctaataaatttcatatacatacatacatacatacatacatacatacatacatacatacggaatccatacacacacacacacacacacacacacagagagagagagagagagagagagagagagagagagagagagagagagcatggataatacattctctaaatggtttcttcagaggggcataatttcctagaattaatcacatgacattttatttgaactttgtattcattgtacattagaaggtgagcaaaggtatcatgaacagatacatggcagcatagcagtcggtcctttagctttcagctttacaccatgagaaaaatgtgttctgtgaggttagtggccttgggaaaggaatatatagataatagagctatatcacagtcatttctcagatccataagtgacaatagtaagtgtcttttataaacagactacagagtttttagcattactatgcaaaactgagtaaatcaactttcaattctgtttgatatcaagtatttcaaagttgaatgcattcagtgtacttttctaaggtctcagtctgcatggaaaacttattctttaggaagattttctcctcctgggacctttacagtgttttcattttaaaacagcaacttggaagatggccactccttggtgacacatcctagtgatctgtgtccatagcatgggcttggtgctgatatttaggtgactttactttggataatttttcctggtctttagtcagttccttaatatgatattgttgggttattccaatacagattattcgatcattactaagacacagcttgtcacaggctctgagaaagatgctgaaggtttacaatgtggctttcaatcacaggtgactgttacattcctactttgctttttcctaacacttgtcaaatgagcttatttagttctggaagatttctggaatctttctggaagatttcctttttactttttgttatttcatttgttggtcttaaaggaaaagaggatataaggatcatgatcctaatttattctaaaatattaaccttgaattcacttacatttgtacagaaatgccacatgggaaacctaaatagctcctgcatacaagttaagaatatagttttgtgtggaaagtatattgccagattttaaaaataatctagttgaaaacggacttctttaaataaaaaatatgttcaagtatgttcacactgtattttggttcaatttgaaatcattatctaatattttatgttatttataaagtacttgttttaggaccacaaatgaagttattgaagacaccacctatgtatgaataaaaaggacaaagtataagtattttggtaaagaaaacaattttttaaaatgcttttgttgcttttatttctcataacatgcctgactaagaggacaccatttaggatctgaatgagagctttgggtttatttttcagattttatttttatttttaatcatgtggggggggttatgtatgtaggtgaaggtgactgtggggtccagaagaggccatgagaccccttcggcaactggagttataatgtgttgtgagccacctaatgtaaatgctgggaattgaaatcagggcctctggaagagcagcaagcactttaacctccaagtcatctcttcagttttgaggtctttctttgacacttgtcacctgggcattgccccagagacccaaagacaaatatttactttgctttttgtaatttatttacatgaactctttaattaatccctctctttgccagttaccttatgatattataataaaatatcgtgttttcttgctgcaaatctgacactgtttattaagaaggtgctggtgtagcaacctcggggttttcacatactccattagtgaaaaacgctttttgcatttagtgcatcagcaaatagagaaaatggcttagtagtagcgtagttcatctctaactggtgaagggatctctatcaatatttgttggaattagtgtgtagtggattaggttatgcattatacaaaggtaatatttattttagaaattggtctcctttgcaaagtcaattgagggtaggaagtgaggaagggagaagtggcagtatgtgccaattctaccagctcttataacagccccaagaattcatagcttagaaaaagatttcagttccttaagcaaaattcaggctattcagtcaactgacagtgactacagcaacatcatgtcctcttataatgtggtgtagagcaatctgctgtgcactagtaaaactacctctttttggcagacaaacaatagcttagtatttaagcactaattgataacaaattagcttgttccctaatagtttgcccaagcaacaaaacttgggcacatttcactgtgtgaaaatagtgtaccctagtgtcactgtgtcctgacatagcccaaattcaaattagagtgattagccaaagatgacttaactcaggagtcagggacaacaaatttttctgattctagattcctgcatatgtgtgtgtgtgtgtgtgtgtgtgtgtgtgtgtgtgtgtgtgtgtgtgtgtgtgtgtgtgttaactagctgtagaaaaggtggcatgcttatgctgtaattactgagacacttattgaagattggaaagcagcaaatattgtcagtaaagctttgtgttagcaagtttcttagagggtatttggatttacattttctttcttttgttttctttttttttgatttttcgagatagggtttctctgtgtagctttagagcctctcctggtactcgctctggagaccaggctggcctcgaactcacagagatccacctgcctttgcctcccgagtgctgggattaaaggcatgctccaccaacgcctggctctggatttacaattaggttaatgtatattcctttttgtttggacaggaagtgttatgtgacttctggagtatttggaagatttttacattattttaatatctgatacaaagaattagatgtgcatgttgtctttccagtacattttattccagaaatttttagagaaaaatttagacccacattccagggataactcatgagtgaaaacaagtacccatttaaaagctgatccacctcttcttagcagacaggcctgagatgtgctcacagagtgagctgtcaccgcactgggttaactgtgacattttgaaatgattgtggttgtgaacttcctaaaggcacttgctccatggttggttaaattgcacacatttttcagtcaaacattttcctggctgcatcaaaggtgttgagtaactgtgttaaccttggtgtgttttggcaatgggagatcaagtaaaagtcaataaatgtctctcagagccctgataaactccaagggcacaaacagaggtgtttatgagctgtgggggacaaactggtcaagtataagtttcccttcaaattgcttattgccattttagtgctagaagaacatattttaagtcactgctttgacagaacatattggttggcattgcgtaggcttctgtgtttttaggggacagatggcaattaccacttctgttcaatgttatcttttagctttaagtatcacatttactggtgaactggactttgctacatttttttacacttggagcaattccatcttataaaatctctttacaaaaaatattaagatgactgcttacataaaaataagcaactgagatatgaagcaaaagtttttcttaaaatgggttcagcatgtgccagtttatctcttaaattgttctttcttatttttcttctacctaggaatggtatagaaagatggccagggataatacaattgcagatacattctaacaagataaaaaccacctgctatcttttagtttctcagaagtaaagtctatattttatttatggtcccattgttctcatgaaaagtaatctctcatacagaaattatgaggaatgtaaacttcataagacatctaatattttcaaacttaaatattgatctaagtgtttgattttaggcaaaatttaaattttatgaccccttaaagttaatattcaacttagcatgttctaaaatcaatcaaatgtaaatgattaaacaatccatgatttactttgtttgctcaatttttgtaacacaagagaaatgctattgattgtttttttaaaaaaaactttcaacatcatttttttaacttttgttatacaccctgacaggtagtaaatataaaattatctggagagaataaaagagaagttatttaattttgaaatatgcttatatttaggcactttagtatttatctagtgaatttatagtatatttaaattcttaagattaatcatagttgcagatcctaatacaattttgtattttcatcttttattgtagcatatttttggtaataaagctatcaggcattggtaatttaattgtgttaggaagcataaccaagggtttgcaatactgcttggagtctaattcctgtctagctggctgagtttcacagtctttgttgtagaactcagtttctgatagtgccctgggcaggtccctaagaagcttcatcaaatctcccatggatttaactcagggatgttatggctctttgaaccagccagtcacatctaattccatttcctatcctgtcacagcttcctagttattccattgtctttagattgatgtactatctttgaacttgtttaattaggtcacaaattacttcccatttttcaaaaccaatggcttcttcttaatatttgtcattcagcatatctgaaccctctgatacacttgactgtccccttctttaacttctttctcctttggttttggtgataatgttttccctataggatactgctctgtcgattacaaaagtgaaccatgatacacgattagccaaaaaaaaaaaaaataggtaaacctcttatatagagaggataaaggggctaacaaagaaatcagagaaacatcactctttacaatgtccacaaacaacataaaatatcttggggtaactctaaccaaacaagtgaaaggcctgtatgacaagaactttaagtctttaaagaaaaaaactaaagaagatatcagaaaatagatctcccatgctcttggaaaggtagaatcaacatagtaaaaatggaaatcttcacaaaagcaattaatagattcaatgcaattctcatcaaaatcccagcacaattcttcacagaacttgaaagaacagtactcaacttcataaggacaaacaaaagatccaggatagccaaaacaaccctgtatgatatagaaacttctggaggcatcacaatccctgacttcaagctctactacagagctacagtaatgaaaacagcttggtattggcacaaaaatagacaggtagaccaatggaatcaaattgaagaccctgatattaatatacatacctatgaacatctgagttctgacaaagaagctaaaattatacaatagaaaaaagaaagcatcttcaacaaatggtgctggcataactggatgctgacatgtagaagatttcagacagatccttatctatcaccatgcacaaaacctaagtccaaatggatcaaagacctcaacataaattcagccacactgaatctcttagaaaagaaattgagaagtacccttgaatgaattggcatagaagactacttcctgaacataacactagcagcacagacactgagattgacaataaatgggacctcctgaaactgagaagcttctgtaaggcaaaggacacagtcaacaagacaaaatagcagcctataaaatgcaaaaacttcctcaccaaccccatatctggcagggggctcatatccaaaatatacaaagaactcaagaagctagtcaccgaaaacaccaaataatccaattaaaaagtggcatagagaactaaatagggaattttcaatagaggaatctcaaatagttgaaaggcacttaagaaattgctcaacatccttagtcatcagggaaatgcaaatcaaaacaactctgagacaccatattacacctgtcagaatggctaaaattaaaagtatcaatgacagtttatactgtagaggatgtggaaaaaggggaacactcctctattgctggtgggaatgcaaacttgtacagccactttggaaatcaatatggtggtttctcaagaaaatgggaatctgtttacctcaagatccagcaattccactcttaggcatgtaccaaagggtgcacattcatatcacaaggacttctattcaactatgttcaaagcagcattatttctaagagccagaatctgtataagcaacccagaaccccctaaactgaagaatggatgaagaaaatgtgatacattttacacaatggagtactactcagtgggaaaaaaaaaaaacaatgaaatcttgatttttgaaggcaaatgtatggaactagaaaaaaccatcctgagtgaggtaatccagactcagaaagacaaacatggtatgtactttctcataagtggatattagacatagaacaaaggatagccagcctacaatccacaaccccagaaaagctaggaaacaaggaggatcctaagagacatatatgatctctccagagaagtgggaaggaacaagacctcatgacaattgggagcatggtggagtggggaggcaggtaggaaaaagagaaggggataaaggaaagggggagagcatgaggggttttgaaggtcaagttaggggaagaacagagaaagacagcaaggaggagccattatgggcttaatgagaaatctggcaccaagaaaatctccagggatccacaaggataacctctactaagaacctaagcaatagtggagaggctaccttaaatgcctttacttcataatgaaattgatgactaccttaaatgccatcatagaacctttatctagcagctgatggaagcagaatccgagattcgcagctaagcactgagccgaacttctggaatccagttgtagagggggaggagtgataagcaaagggggtcaatatcatgctgggaaaacccacagaaagagttgacctgagcaagtgggagctcatgaccctagaatgacatctggggaaccagcataagacccaaccagaacccctgaacgtgggggtcagttggggggcttggtcagtctatgcagcctcttgcaacgaaactagtatttttccctagtgcacaatgggctttgggagcccattccccatggaggcatattctctcagcgtagatacatgagggagggcctagagcccgccccgaatgatgtgacagactttgatgatccaccgtgggaggcctcaccctccctgaggagccgatggggatgggatgcagtgttggtgggggaatgggaagacaagggggagagggaactgggattgctatgtaaaataagattgttttaaatttaaataaaaaataatttaaaaaataaaataaagtcatccatgggtgtccatgacatgctcctatctccaaaatttttatctgtattatccatatctctttcagtgtggaatgtccatgtttagttagtgggatgggttctttaatggtcctcagggactccagactacccaatcttatactgctgtactatttatcttcactttcacttcaagcagtgccacctcaccactccacttatctaggaattagaaaattcgtttcatcttgtctttctgccattcacaagctatctgtcactgtgtcttggaggtttgatgttagaagtgtctccttcccacccattcactcaataccctactcttgagatagttgctatttcctgtacttttcttcctgcttccattcaagctacaaaagaactccaaaattttaatcttaagggaactgttcttgtggcattttttaattttagaagcactctttattttacatatcaatccccccattccctgaccctcccatcctcccatagtacgcaccaaccctccccccagcccattccccatccactccacaggaatagtgaggccctccacaggggaccatcaaaatctgtcatatcacttgggggagggcctaggccctccttcccgtatctgggctgcaacagtatccctccatagggaatgggcttccaaaatcaatttgttctctagggataaacactggctccactgttagaggtcccataggctgtccaggcctcctagctggcacccacattcacagggctttgtttggtccaatgctggcttcccagctttatgactagggtctccctgctctcactaggtcaagtcaactgtttctgagggtttctccagcactgtcttatggcttttcaaataaatgccgtggctactttctgaagtgaagaaatgcatgttcctcttctatctggtgtggtgggtgagggacatacaatctgtctctacatgtctggttatggtttctaaatccacctcctgacttcatgtctcatcatcaacattcatacacatattgcatgtttcacattttggtggaaggtagcatatgtttaactagtttgctgagaaatcagaatccattggagtatcattgtagaatggccttatttttcttaacatcttaattcttttctttataatcttaattttcctctattagatcatctttgtctttggatactacatcctctaataatataaaacaacttctgaatcttgatataatttttcttcttttttcttttaaagatttatttttattttatgtatattggtattttgtctgcatgtatatgtatataaaccacttgtatgtagtgtctgtggagttcagatgagggctaatgaccctctggagttacaaatggttgtggctgccatgtgggccctggaaattaaaccctctctaaaagcattttaaaatgctcttagcttctgagatatctctccacctcctaaacttgcttttccaaaaaattctattttacttaagatttaaatctgatcccaagtacttcagtcttcctagcataagacctagcttctgttctaatggcatgccaggatggtaagcactagcttgtggtcctctggtcattcaccacaactatctctactccatccctactccttggttcatccatttgaaataacagacaatggggacagggcaagcagatatatgttcacttgctttgaatagggtcttggagtctcattgtatggctcactatttattggttttctgatactgatgatactgtcattctgccttgtagacaagggtctcagaaaagctacttaggtctccatactccttatgtggttaatttcagatggctcctaggtgttgggatccacattcttatatttgaggtacccctctggtacagtgactctacacaggactcattctcaggctgctggtacttgcaagaatcagggtttaaaggcagaatgagttggcctctttacttcttggaaattttgtcttgtattattccttgtatgtatcttttctctacctgtataagagtgggaaacatgcatgaagctcaactattctacagatggctagtgaagagggaaaatcctatctcctctccctctatggccgggtaaagattagttagcatctccctcttctgatttgacataattaaggctattttctataaccctatgattacatttctatagagatacagctttcctaaaagagtcccccctttttgaatactacactatttttgtagctgctgagtgtctggttattcagtacttgaaagttgacctgtcgtgatggatatttatgataaatatacatcaacataatttcaacaatttcaataaaatattatgaattatttttgtattgtttattgatgaaaacacttttaatattgttttcatattgcgaactaaattaattcttatttccctttaccaacactgatttgaaacaatttcgaattatattttttaagtaaatttttttatttaaattagaaacaagtttgttttacatgtcaatccctgttccctctccctcctctcctcccctgccccctactgactccctatcccctttctgctccccagtgagggtgaggccttccatggggatcttcaaaatctgtcatatcatttggagcggggcctagaccctccccagtgtgtctaggcagagagtatccctctatgtggaatgcgttcccaaagtccattcgtgtactatggatattatctagtacatcatcatcatgaaagaaaacatcagggaagaaggttctttcttctccctctacaccactcccctgaagcaagtcacaaattctaggtgatttttctgtgttcctaaagagtgtcttaagactctaatttgtagatgccctcctcatttccaatgggaaagaacttcatccctggaaataaacagtcaggagattctgaatacagacattgaaaatttcttctcattggctatcatcagatcatactgtttgccatagttcttcatgactgtatatttaacatggaagtatatgaccttacttattctcagctcctctttccatgaggtccgttctcatatcttatgaactttttaataagtgtatctatatgtgttttttttgtttattttcctgttaatatttttgttgtagggtttggctataaatttggaactggtatagaaaaacagttttcccccactacatttacattatgtttggactgcatggcactaatgtggaagatgagacacatcaattaaactctataggaacctatatgttaatgccaatgtaatttcttttgtttatagtatttggtcataaatccaaaatcaacagcaataaataattattgaaaagtttattaaaaaatagtccctagtctattcagtcttaaaaaccttgtcaaaacttgacccaatatgtttacaacatctgtgatatagcattgtacatatgaaagttgtcagatcaaaatgcctgtgtaattatcatttcactttaaagcttaattttgactggacacaatggttcatgtctgtaatcctggcattcataacctaacatgggataactatggtaagttcacaattatacaaattcccccttctcaaaaatcaacaacaaaaagcaactaaagaaagaaagaaacaaaaaaaacaaacaaaatgcttctttttttgcctcagcctcctggaatatgttcactactcactacaatacataaagccctattacaattatctcctattccaaaacaaatataatttggagacttttcctttgatggaatgtcaaggaggtatgtttaaatttagaaacgcaaagtttaaatgaagaaggaaatgaatactataattaactttattcagtgttaatgctaggaatgatgaaggattagtgcattttatgcaaagttgttgaagtattataagttattctcatcgtgactattagcactactgacatataattatttctctaaatgattctcagatctctcattagttatactcactgcattggtatagtagttgcatggaaattgtaaccaatccatgataaccaagagatttctgattgaattttaggaccacactacaggagagaacccatgcctagtatactgcaactatggctaagaaccacaagctgtggggctcacaggccttacgagagcatctattgctgtcattttacaaaatggatatagtatcaaactgatttccaaatacccacatgcacatatagtagtgtagctctcagtcttcaccagagaagtttctttttgctgtgaatgttagttattacagactcacaactggcactgtgtggagaataagtaattgtggggtagtcatccttaaatgggacagcattagcaacctcttgtgctagctatttttagagtaatctaagaaaagagtcacctcaattgagaaaatgcctctgtaaaatagggctctaggcaggcaaacctgtacaatattttcttaattagtgattgatgggagagagtcctgcccattatgggggaagactgggctggtggtccttttttgttttctataagaaagcagactgagcaagtcatgacgattcatcctagtaagcatcactcctccatatcctctgcatcagctcctgcctccagattcctgccctgcttgagtttctgccctgacttcctttgacaaggaacagtgatgagaaagtatgaggtaaataaaccctttccccctcaagctgcttttggtcataatgttttatcacagcactcatgactttaactaagatacctccatcctcactcttcagagctcatggaagaggaagaataaagaccaagagcaagaggttggggaggtctgctgtgaaactgtcttctggacatgacatagccatagcatttatgaatgcacagcagctgtggtagcctgcacaagagctctacagcatcaagccagttgtcattccatcacaggtagaaagggttggtgttccccatttcctagctgcagatattggtatctgacagcttctgggttagaaagagttaattttcttcaggactgaggcccctggtagattatccaggctccaacagaagactctacacctatgaacattagcagcactaattgggctcagtatgctattaagaaaggaaagacagaagtggttgttaaattgggacagagacatggtagaggggcctggggtgggtgagttggagggccaaatatcggtggatatcaacaaaatatattgtatacatgtatgaaatcctgaaaaatataagtgcgaaaatattaaaaatatgtgttatatattgtatttagtcaaaaccagttgaagatctccccactgaactctgggtcactgtttttctctgtgtgagggtgatgtggcaggctgtgatactaaacaagtgtgcatagtttaactttttatggaaacactctaaacacatacataagcaatcattagccatagaatcacatgaatttatctctgtagaaagtcatacagaattgctatagaaacgttaagctctatcaaggtaacctttcttcccttatcatagtcattatgagatatttcaacacttacttaaaacgaagttgtccttttccttctgcctagatgtcatatcttcttggtgaaagaaacatctaaaaataatccccttccctgtctaattgggtgtgtatgagcggctgtgattggtattctgattgcacttagatgcctcatcatcgccatttttgtttcaatactgtcattatcacagttttacattatcatacttaaatcccttatgatatatgcagacaaagttgtaagagatgcaagttataattgtggtctcagaaaaaaatatgtgcaactgagtttctgtgaaggacatttattcatgaaataggaaagcagaaataacccacagtaataaaaggcaagctattaagagaagtagagggcgaccttccaatgaaagatgtaaaaatttgacattttcctattattgatgtaacatatgacacacacagaaaggaagcacgtctctcgaaagaggttctgttgttctgggagaatttgtactatggtgggagattcttagatacaagaaaacacaactgaggtgttttggtcatttcttttcagtttctattttgagcttctggacatctgaccccagcataatttttctgtaaagcatgtctatttaaagtgaatatttcaaatagatgctgaaatcactttaagatgtataattttgaaaagtctgaccaacatagctgcttaaaaagctgaataaggacaacactaaatagattgctaacatggaaaggagaaagttcaccaggnnnnnnnnnnnnnnnnnnnnnnnnnnnnnnnnnnnnnnnnnnnnnnnnnnnnnnnnnnnnnnnnnnnnnnnnnnnnnnnnnngagagcaatagagaaaaacattttccaaggaaaaccacaccagctggttgctcattaccaaatagtcattctcagatcatatatgtacaagtagcactttctggtctgtgcaggttgtttttttataacttagggatagacagacagatagatagatagatagatagatagatagatagatagatagatagatagatagatagaggggatataataacaactaaagtaaaaagattccatgtatttgttgaagggaagaatgatataattgactatattttaacttcaaaattaaaaaaaagactttcattataaataaaataaatttaaacttttagataaggaacagtttatttacagcatgaggttccaattttatgtgtttgtgtatgtaaaatatgttacccatatatacccataatgtatatacgtttgaaacattttaaaaacaaaaattaggttattttaattaattgtgtgcaagaatccaaatttatcttagttagggattctattgctgtgaagagacaacatggccacaacaattcttataaaggaaaacatttaattgggactggcttacaatttcagaggttagtccattttgtcatggagggaaatatggtggttttcagacagacatagtggtggagaaggaactgagagttctacatctggttccccaggcatcaggaagagactgaaaaacactgggctggtattgagcatctcagacaccaaagcaagtgatgcacttctctaacaaggcctcaccttctaatagtgccagtccctgtgagcctttaggggctattttctttcaaaccactacaacaaggaattgtgggttaaaggaaattgagcttttttaaaaatttgtataagtacagtaaacaatattgtgatatgaaaacagagagttaaatagaaacagatttgcaaagtacaaactacatagcctctcagcacatgttcttgtattctgcctttagtaaataggtgcatcttaaaataccacttcctttgtgtatcagcaaacagcaacttgtttgttatttactctgtaatttctccttccattgagaaaaatcatttaagaggaatagtgcttgatatttctttaatatagatgacatggtaaattttatattcacttctcttttctctgaaaagttagtatgtcagttcggtgaaatctatgatgggcagtcctgttaagctaggtacagagtagaaagcaggaaattgcgggttggtatcataattatctttgtaaagttaattataatttctcatagttaaatatcaaagaaacaaatatgggtgacgggactcaaactccagtcctataacaattaaatgtttgtttgtttggcattgcatcaggctgttttctaaggtacactgccccattggatttttcttcattatgctagcatttaatctctccacagcctttgacattttctgaagttaattttgaaatttctttcttttatgtcaagtcttctcttcaactaatggtgccacaaaagctagggagccatctgtcattcgctgctttatcaatagggcctctctgtctctgctgtactctctgctggttatttactgagtgaatttctaaagaatagtaaataaaatgaggacctttgacatatttgtcacaattcaacagtagagtggagagagtttagccaagctaataaaacaaggagccatagcattagtcataaattttgggaaagaagtgatgaaagttattgtttgtatatattgttatctttagtgagggaaacctgaaagtctaatacacagctatgtcactcaataagagagtttatcaagggagaaagataaaaatcaacaaacacacacacacacacacacacacacacacagagagagagagagagagagagagagagagagagagaataaagagagagagattaaaagaaaaagagaaacacacacatgttcttctatactagcaatgtcaaattagaaatgtaatggataaccattatgttctcaataataagatacattttaagagttttatgagtaaatctcataataattaagccttattgatagccctagaaagccctaaataaacggagacacagtctagctggactcactattttaaacattcaccactgtgatctatgaggtcaattagagtctaaggaggttagaattggatttcctgtggtacttgaagctgattgtaaagtccacaggagcagtaaatgtgtgaaggcaggcaatgagattgccggaggaaatgcagagagtcagagaatggggacgtttgcagcagaagacattttctgaacatgacgtggacctgtactcacaaactctctgcagttgcctctgcaaaattggggcatgaacatttatttcattggagtgaggaaagagccatgaggacctctatcagggacaattgacaattgtttgtgaagggactgtgtctttctttagtgtggttaccactattaagttgctcttgccccagtaaataacttcccactatgtttctgcagcaaactagttgaaatcagtgggttagatacaaaagaagtcatgaaaatggggggaggttgttgggaggaagagttctagtgagaaaggggggataaaagaggagaatcaggtgaaaatgatgcaaattcattatgtaagtgtatgaagttgtcaaatcacagaaagaaaaattgaaaaagaaaagaacaaagaacaaatttatttaataacagttatataacacacacacacacacacacacacacagagagagagagagagagacagtttcagttagcaatctaaaaactaaaactaatacaatgtttagatgacttttattgaccttgacttcaaaacttattggctatgaacggaaagtccaagaatgcagtaatcattcagttcatgaaactggatgtcttgactggtcttaagtatatgctggaagcctgacaaagtaggctctaatgatagtgaaggaatagacttgcttgcaaggagacagcaagcaggcaaagagcaaaagcttccttcctccatgccctcttataggcttcaagcagaaggtgtggctcagattagaactggagtaaagatctagagtaaaggtatattttcctacttcaaaaaaatctggattagacgtttatcttctcacttccaatgaagcaaaactcccttataggtgtgccctctatttgggggtttaaggtaattccagatgttgtcaagttgacaagcaagaattgccaccacagacttgttctgtttataatttactatttgaagcagtttttaatcctagcatgagatttagaattttagtgatcaccttgtttcactgaagttaaaatttctagtcttaagttcacctgtgagtttgagaggtttataaaagaaagggagaaagtgccaaacacactccattttaaagtcagtagtcagcatagtactcagnnnnnnnnnnnnnnnnnnnnnnnnnnnnnnnnnnnnnnnnnnnnnnnnnnnngaattaaattattaaaggaagtaaagaagctgattcgtggcttaaggactgtttatgtggaaaaaaagtgactaaagttttggaaataattacttgaaagtaggctttcagtattagttgtataattcatgaaagggctttatcccccaaaatgttaaataaacttctagacaacattaaggtataatataagtaaaggaatattttaataaaatgtcattattagagttataaagtagtaaactagtgaagatgtgaagtttctctttagagattattaacttcttttagttatatttcaagtgagatttttgtcttttttatacatgatattggtaacttgtagtctcaagaatacacagttagtccattatatgtgtgctatagtatcaatcggaagtggaaagggaacctctttgtgagtggtggtgaggagcaaagcatactaatgctgtttaaggtgttaagctgtaatggtactttcctccaaagaagccatggagtcccactatatgataatcaagcaatctttctctggatggactagttaatgttgaaatttaaatgttccaaaagccattagattagaatttgtattgatataataattctacacatttattgcttataatgtgagattttagtacaagtatataatatataattatcagatcaggctaattggcttgtgcatcacctcaaatattaatcatgtgtgtgagtatatgctttggacattcaaaatctgttcaatatatatatatttcatatataaaattgttgccaaccatattcacccttctgggctatagaacattagagttatttttcctgtacaagtgtgtgctgtacccattagccatcttctcccatgtcccttcctcaccattcacagcttctgatggccactggccactgttctttctttttttttctttttttctatttttggtttcttgagacagggtttctctgtgtagctttggagcctatcctggcactcgctctggagaccacgctggccttgaactcacagagatcctcctgcctctgcctcccgagtgctgggattaaaggcatgtgccaccaacaccaggctgttctttcttttttgagataattattttagtgtccatataagaatgagacactatgctctggctctgtgtgatctacttcatataacatatgtccttaaagctcattttgacttttttactgtgagatgtaggtttcattttaaaaccccagtgatgcagcacactgttgttaaatatacacaggttgccatacaatgtatctctagaacttacttattttccacagctctaatgctacacttgatgaggtataatatctattttctttttttcaattatcctctttattccttctgagaatctgacaactttagatttcttaaacaagtgtaataccatagtactcgatttcctggaattaattcatttcttttgaaagcgtaaagtcctcaaggataattcttgtttgggagcatgaataactttggtgattaaactttattgccaactggatttggatcactcaggaggcacaccatggggcatctgtgagggcatttctaaagtagtttaactgaagggagacagcaaatcctgaatgggatggcaccatccacgaatgtggttccagaatgaatgagaagaaaagaaggcaaacatgagcttgagcaccaaaattcatgtttctgtcctgtgagtgtccctggcatgtgtctgctgccacatctctttctccatgctttcctcaacatgatggtttggtcctcaagctgtgagctgaaacaaatccctccttccttatttgtgtttccttgaatttttagaacagttttaatcccaagaataaacaaacaaaacatcctgatcccacatgttggattcagctaatgaaaatgctattctagagagtttattgagaaactatctgttaatctatgaaccaaatggaaagaagttgaaagcagaaaaatggagtttcacaataaaaaaaaaatctaagcttagatgtaaaaatcacacctcatagttcagtgattatgcattttcttcttaaaccttaaattacatactaaacaatggcactgatattctatttttaaaataataactcttccctttaaaaggtgtaatgtgtttctacgtgttacatgattgtattttagattctacctctgggcatcagaaaagacttggcagtctttctttttttctttttacttttttaaatttttctcatttttttcccaaagaaagtgcagctccataaaaagtggtaacaaagataataatgcagaggtggtttggaggaagcattttctttttcagaannnnnnnnnnnnnnnnnnnnnnnnnnnnnnnnnnntcctatttttttccagaggcaaatcaccattacagaatagaatgctcaggtagttggggcagggctgacacagacctccatcagaggcctctcaaggttaggaacagtacctgactccaggagagggagaagctaattaaattaattctgtgggaaagtgacaagatgactcaatgcatttgtagtgtgctctctgctgtcagcatcacctggcctcttctctttagtgtcacacacacacacacacacacaccacagtgcctggcatgtgatacttaggatttttttttttttttgtctcacttgcgctgcaatgcgaacactggacttatgctatgatggatgaatgccgcaggaaagaaatgtaattgccttggctatgcggcagtaaatggatattccctctggaaactcaactcgcttcatttagacccaaacatgccaagcagatgcagatgatcagctcacagcatatgacagaaacggatatcattctcttttatgtgccgtttttaatgtaatagcaagctaacatctgttgttctgagcacgacaaatctgttcttttcaatgtaaaggtttgctgagcattgatattttactaagaatagagtgtgtgcaattagagtgcactgtattttcatgtcagatccagaaggtctttggaaaggtcattgatgttgtgtatgacccattgagctgcaatggtaagatagatgcagttacaagacagaaaagtttaagggatattgttccagagagaggacaaagcaatggagaagaaagaaaattgctgtttatgggatcataaaccagtattgtcaactccatgtttcggcaaaacacttttggtccgcagaaaaaaaatgctactacatactcttaagaatttgaatatcttctgtgatgttgtttgacatgttgacaaagtctttctaattctcactttagactcttacataaaataaatagtagcaccggaatcttcttctgaaacacagatggcaatgtcactcccatgcaatgaagaagtattaggagggatgtgacaggaaactctagaatctagacaacctctttaacattacttgtcttatcttaaagtttgtttagttcatatatttaggcagtgatataataaatctaaaaacctgttacttttttgacgggacattttgctgtatgaaatatgtcgatcttttgtgtgcattgactctgttggttgcaaaaaggacatagtggaagcatcacttgaggctactgactagaagatccaactcaacatacatctttcacattacacaccatctttaaggataacccaattaagtcaagtggtagtggcgcacaactttgatgccagcactcaggaggcaggaggatctctgtgagttccaggccagtcttgtctacagagtgagttccaggataggtcaaggctccacagaaaaatcctgcctcaacacaaaaaaagaataacccaattatagctataattattgtttattttgaattcttcatgtcagctgaaaactagttttgaaactcactaaagcagaatataatcttaaaagaattataaatgataactatcattcataagaaaaaaataacattaaaaagtttgaaatcagttttttacgctagtaaattgtggatattgcattccactgtcaccccacctttcagccctacaatggttttcttgtctttctgctaaaataaaaagcatttttatcaaatagttttatgtaattatatatgtgtgtgcatgtaatcatatgttcaagagaattaaaaaattgacttaagcagaaaaaagtgaaaagctaaaaatcttagttttcaatttaatctgtgaaatgatgctaccatatagagtgataccacgatagatatcagggacgagtcactacattcagaggcttccaaagccacagggtattcttgttgagaatgggtgaccttccaagatacagaagagcatcgaggatcaagtgaaatggtgattcatatcttgtgccaaaccatatagagatgtgagcagtagcatgtaatatcagagggatgcttaaacagggacaaggtgctgaaccaaagatgtattagcacaagatgtgcaactagtgcaactctttttatttacagtttcagttagcaatctaaaaactaaaactaatacaatgtttagatgacttttattgaccttgacttcaaaatacatggtaaatgaaagctatgttaatttattttttttagaaatgtctcataactgaaagtggcattacataaattaatgtttaatctaattgaaaagaacaaaaatcatcttcatagaggcaaataattcatggtgtgggagtagagaaagaaaaagcaagttttaattcagttgtgtagcttttttcttatagaccatggcatatatgaaagccaaaacagcaattcaactcattgaattcatcaaacatctttaaaaaaaacatatctagtagttattataaaagtccaggatcaaatttagcaaaatatcagaaaatattacattaagtaacttaatccagatgctatttattttgtttttcaaatgctgacttatgtactagggattcaaattgcctagagattacatggtcatttagcaagtacctggcacacattgcaaaaggctatgcagctatgcttggcttaactgtgcactgatactgtacataattattaactcctcaaatctacttttgtaaaatggatgaaaagatgggaaattaaagtctttgtccaaatatgggactgttatgtacaattaatctctgatttgtcaaagtatcaggtatggtgccttcaacctgcacacttgatttttcatggagagttcattcactaatatcttgattggcccatgcctggaactatgtctaccattgcatgaataagtaggttttcttgtagagtgagtgtgcaagggtcaaaatcttatgatttatcaagtagaatatgaaaataaaatagaaatggctttcaagtctttcaccattctgcctactcttactggctgtgtctgtattggaatctgagagtaatgtggtctaaatgaaccttcacagagtatagaattttttcatttggtctccaataaggcataaaatacacattactgatgtatttataaactgaagttgaggttagttctctaagcaacaacatctactgatggcctctttttttgcttatcaaagaaagcaaattgagtacaatcaagggtgggttacgtataagaataaccttgagccatgataaatcaatgacttatattaatgtaaatgatctcatgagttttaacattttgggttattatcagaaataaattatttatgacatatcattgcattataatcctgacagagaatccctgataaaattgccagttatccttcttggacatttttatgtcactttagattcttggctgctatggtttgacaacagtatatcccctaattttaaataatggtcagatacccatctagaatggtctgattgcatagaatatgctgtcagacagtgcagcctaaggacttcttttgaaacagtctgtgaagcaactacttaattcacctatgatttcttttctttccttctgaagtttcctcattattcctcctaatttctgtgaacacacatttcaaagatctgttagtcacagaaataatctaaataccaatccagtaacagattaattgaaattgggttgcattgtaaagagtttttgacactaaaagaatcatgatctttagttagtaatttcatggcataacatgatgtatcaaaagtgtatgtcattccttttaagaagttattaatttattagtgtgtgtgtgtgtgtgtgtgtgtgtgtgtgagagagagagagagagagagagagagagagagagagagagagagaatgattccctcttgctcccaacctttgagttgacttcattatttggatcatgttaggactaatgtgggaggaatgggaatagagaatgagttaaggagtcaattacttctccttactgatgttatagccacaatgaagtagagatgcttctcagtgaatcactcagatgttttggtttcttactgtgccaagcccaatgctctgagtcagctattccgttttcttttagtcatcattcatcaggctgggcactaccaccatgttccattttaggtacaataaaatgtaagtttagagatttcatgcaattttttaggatactgaaatcaattcaaataaccaaactgtgattgaactttagtacactagtgtaaaaaataattgatatgtctgtgatacacatcaagaattaaatgctagatatactttaaaaaagagaatcatatataaaggtggatatatacctacatcttctctaaaaatattcagaagataataaatattttcaaaagcatcttaataaaaattcacaggttcagtgagattataaattagaattggcaataaatgtcatcaatttcttttcttttcctatattattaaaaaagtcacttcatctaatcaacttataattgaaaatatcactcagctattttaaggaaattgctccaaaaccttcatagtcccaagctctacgtatgtcagcaaacctccatattgttttaatggcaaccctgaagacatggcattttccttagggttacaacttcactatcaattacatttattttttcatggttctaggtacttcaataaccaaaaagttgaattcactcatccggaaggaaaagggaaattttctgatggagttgaaactagaaaaaaaaaagtaactctgtgccttgttgatgactcgaatgtcgttttgcctacatcctgtttttcctccctgcatgataactatcttctcatggtcttctttttaactctgtagtctaattccattgtctattcatacttacgacaataatgtgtacattatagcttagctgtatgtgagggatcacatgtgctttattttctttctaaatttaaatcacttttcttgggattatactttctaattccacttattttccgttttcccatatacacaagtacaaataaacataaaagagcacttaatattaagctctttgatccattgtgaactatttttttccagtgacaaggctcaatgagtaagggtggcatccataagtgagtttcttattgcttgattttatttcatcacacttgctacaagaagcatgatgtttcatttcctagactaactgaagtacttttcttcagcagcttgagttgggaaaattccaaagtcaaacttgacttgcaaggtataattgtcagcatgtcctgtgttcagaatattcaaatcattctactaggtctatagtgggatctagtcatttgaagttcaggtctgtcttgttccctgaaaagcattctcatattaattgtccaatctcatattaattgtccaaattagtcttccctcttgatcttcaagcctgtgttggaagtccctttcacaagatcagcttcctttttgattattccttttaaatatccataaactgttatatgtgtgattttacataattagcatgaggaggtatggattaaattttgcaaagaatgcatgcacatctttctagggaatacaatagagaaatatctaggtctcttttcccagtgaagtgacacaagcaagcttgtgtatttttaccagtgatgtatgagtgcaagaatatgtgcatcatatgtatttcttcacacatggaaaaacacatgtccagaaacataaggcaacatgtgtgaaaggtgaccaatatggaaaagtcatctaaactttaaaccccagagtattaccacaagtcgatgtgactgatcttagtggcagattccagcctcccaaagaaccaacagtgttcatcaattattatacttgataacataatgaatatgatcaaattggtacaaaatggcttgtgacctcatgcacacaaaacagttgttcaccatgcatgacattattagagtgaattatctcatcagagagtttcactgtgtcaggaagttcctaggcttataaatcacagcaggcagaatatacaagagctcagagttatgattctgagggtcaatggtgaattctgtgcaagatttatgaaatccaagcttgctgggttgccttataatgacactgtgtttggccttggagcctgttttgaccaaagggacactgaggctgaagtagagggtttggataactggtaatgacctaattgaaaggctgtgctacctcaacaagccttgtcaagtcctcttagggatggataacagccattctgcctgtcttcaccaacctatgccaacctatgcttcatgagaaaggggggaatttttgcagccattaactatggaatacctactttagtacaaaaagggtgagtattaaaagtgaaaaagtacatttaaaaatcaggccaatactagagatgaactgagtacttactctgaacagattttatttgttctgtctttgaagaaagaatatcatgagaacgttgtgctcagaagacagtaataatgtgtcatctcagggcagaaagaaaaataagaataaattaaaacatgaaaaatctggcaatctgggcaatagtgtgtgtgtgtgtgtgtgtgtgtgtgtgtgtgtgtgtgttatacaaatgttgaaaagtagacaaaacaaacactgagagttccaagtaagtgtcagctaaaagtcacatgacacccagggattctcaacagaaaccctggaaaatgtagaattgaagtacacataactgctgtgtgacaaaacatttccaggggagatatacacacatctacacatatattcaccccatatagggatcccatgacagacaaaagcacagataccacaaaagttcaacttgaaatgtctcaaagacaactgcatcaccctgcccccagcatgtgcagctgctcacaaagctggtaatctggaacacaccctatggctttcaggcatctcgcaggttatgaagtatccctgccaagtgactcaactggtctcaatcacttccaagcagattggcttgtttactcttggagtgaaagacctagagtatctggtcagtttcagggacttcctgaagctttttgctcctgcttcctgcttaaggagctcctcagcaggatggaatttttcaatctcagaggaaactgttacacaacaatacccaacaagaattccacccccaagattttaaaaactgaaaactgagacaagcatcaataaatagttaaaataaatggaacattagtaattataactgagtgaactagatgctctagttaagtgataattggataaaaataaatatgtaggagccaaagtagagcaattgcttagcatgtgtgggaacatgaattcaatttccagcacccacagaataaatacaactagatgctgcttaccataaacacatgtaaaaagtgggaattaaaaaatactaaaccttaaaaataacaaaaattagatccgcaaataaaacctcagaaagctgattttgtatgaatataatgcaaaataaaccttaggacaaaagcaaatagagataaaatcatatttacacattaataataggttcagttgactggagggagggacagaaaacttcctaacatgagtacatacaataaaaatagatcctttgaggttttgaaaatctattgtagattcacctcaagtgtgggagactaaaagaagaactcacaaggcaagagaactattctgcattttcttccatcatgggctgtgggtgcagaacattgagagctccttttaactcacaggccctgtgtgtgtgtgtgtgtgtgtgtgtgtgtgtgtgtgtgtgtgagcatgtgtgtggaggtctgaggacagtctacatgcaatagctcagacactgcccattattttgtttcagacagaatttcactaagccaatagctcaccaagtagggaaggcttgttggtgaggattgcaaacatctacttgtctctgcttcccctttgctagacttttaagtgggttctggagactgaatttaggtcttcatgcttacaagcagtcactttacttactgaactattcctttcatctctttcatgattaccttttacttgctcttgcattgtgtattctgccttggccaggaatagtttttgttcttggcttctccagcttcaacatttgacttacttagttccacctcataaataattttcatgatgccttaaattttgcctcctctctgcttctacaactaacaaatttcctgtaatatattctaattccttaacgatggtgatcatgtgttcttccacattccatctaacctgaaggcaaatgtatagatttaatatatatgcagcatatatattagaaatcctaccaaaacacagatggatggaaaaatcataatgttgctgttggtcactatgctcccatttctgatcatgacctttgaggaatatgtaaaggcttaattaatatttattgaacacatttttatataggtgaactagaaacaggtaatttccagtaaaaacaatatctataacctgacgctctataaagagactttataacgtgtaagccaaaaagaacttgctctcagtagcatttgcaatgaagttaatctgtagaaaggaggaaatctgtccacattttgctcctcaaagtaagagcagatcttgtcttttttgtttgtttgtttgtttttcaagacaggatttctctgtggcttttggaggctgtcctggaactagctcttgtagaccaggctggtctcaaactcacagagatccacctgcctctgcctcccaagtgctgggattaaaggtgtgtgccaccaatgccctgccccagatcttgacttatagctgttgttgatccaatattgaatcctgtctttacttgactacatcaaaagatgctggcagcagctgtatctcctacaacagatacagcatttcaaaaaagcaacaattgagatcttgcctcagttgcaagcaacaaaactaacagttgcaatcttcatttagaaataaaatgatctctttcaaaggatgtagaagctttaaaaatagacttgaatgtggaaagtctagaaaaaagggtcgggggacagaaataacagctatgggtatgtagcagttagactaatcaccctttcccacctttggttattccccaagactagtgccagacaaaagactttcctgtaaagtgcccttaatccttaacttgatggtgagttagaacacctggctcctgtaacattgagagatgggtattttctggtgagtgctgtggtgggttttggtttcctggatatgtgggtaggagttaggcctgccttgtgtgcaggctggagacaaccatgtatctaaactctaatttttttgtttgttttgtttttcgagacagggtttccctgtggttttggagtaaactctaatttttaaacatttgatacccaactacctgcaagaagatgaagcaaagataacatatgcatatgtttgcatgtatgcatgtcatagcatacatgttgatgccagaggacaactacgagtgttggatgtcatcttccatcttgtttaagagaaggacttgtctctatataaaccatgctcaggggccaaccagggtattggcctattcttcattgaaggagcacaggttcatcatgtttacaggacaagtgctttaccccctgagctgacttcccagaccaagaaaacctttcctgatctttcttcccattaagcatttctggagatatttcataagctgaatttaggaacctttaatataaggcatttgttggtgtcactagaatgaatagaatagataagaaggaatctcataacagactcaaatatattttacatatgaataatatgtaataaaataggcaagtgactatcaagagtagtgtgtacactgtcccataataatgagcgtctctgtgtcatcaggtgttaatattttgaggaatcttactaatgggacatgtaatagtaaatcacttcagctcccagaattctggtgtggtttgttttatgtccagtaactagaagatttaactgattagattgcttttatcaaaattttgcaagtacaaggaagttgattctcaaagatcttaaagaaactggtgctggtaaagttctatgtgacattactgtaggtagacatatgatgtagtacttgtgtatttcagatatattctcagatcaattgttttgttgatttttaaatttattccatcccagaatacattcctgtaaaatgtatagcaaaataatttcttgtgatttggtataaatataaacaacttccatgtgcattttgattaattcattataagcttgattcagtgacagcaattactgttgacagtcaagtctccttgagtgaggaaatcattttccaaggtttaagaattaatgtttctatgtaaatctttgataattcaagggagttaaaaactgttggaaattttaatagttttaatataaaatactttacaaactgacctttaaaatcttgcaacagatttcagtatatttggaaagacaatattttcaatagaaaataagctctgcaggtatcaaataagaacaatgttctcatgttcaatactacatcctccaaaagcaaaataaacctcaaaatactcagttttggggctgaagagaaattgccagatgtcctggttttgatcattagaatccacatggccaaacgctgacttctacacacacattgcagaagcttggcagatgtcagatctcaaccaaggtaattgcaagcagtgaggacacagcattatctgagtggatgatggtcacactgtcaaaaccagaggagaagccatgaaaaataaggaacccattacacacttgtaagaatgaagggaaaatgctaattttcttcatagctaacaaagaacgatgttggtgaagctgcctaacatttataattactaaaaaaaaaaatactctttaaaaccaaaagctgaagtgctcaacagctccaagaactacaacaagaaattgtaagggtgaatggacaatacactggatgatatgaggtcccttgatgaagtctttttgacagcagggagggaggatcaactttttaagctgaaagaaataataagtccattactgtgtctttcagctttaaaaagttatgattcagaaatatagaaacaactttgatattagaattaatagtttcctatattaaaggaaaacttcatatgaggaaaattgtgacagatatgggtagatttatgaaaaagaatcttgtataactgtttttctaatttaggcaacatataacannnnnnnnnnnnnnnnnnnnnnnnnnnnnnnnnnnnnnnnnnnnnnncctaaatgcaagcatttattagctgtgatttctcacgacttaacagtggcagatgtcctcacatgaagcatgtgagtgtgccagctatttttaaaattgtatatattctgcacagttcttatttgaaatgcaactaggagcagagcagtagatttgagatattttattttaaaggcaaagaaatttccatatttctgtggcaaattaacaacaccatataccatcttgaatgctatattgattccatcactggcactgtctacgaccagacatgtaagttacagacttggctatcttatcagtctgataattgaatttcaattcgcttagagaaactatgaattaattgagccattatatttaaagttggtaataaacaatagaagcaaatacttttcttttcaaatgctcttattgcctttaaccattttgaattattaaaccatccaaatcaatactactcactaatttttaataatgagctcagtgacataaaagtaaagagtttttaggaagtgattttccttttgaagcctaccacttatatgcatggtacaaagagactttgtctcacttttggccatttgaagattattgttaattaattttctgctcaaactcctgcaatctcaacactgtttgatgacttacgatactacagccaataaatcttaacttaatttcataaacatagttatttaacctaaatttgattcttcatcaattgagacaaatcaatttttaaacctcataatattgtgattttgaataatgttgctctatatttatgttggtttatgctttagagaatctaatgtttgtgtaaataagaaatttctgtgtggaagagctaaagtagaattacagttaacagtaatatacatgaaatacatacttcaaataaataatttatcagaattggtatgtaacaaagatacacagaagcatagtgtagggagaagactctgctatcatctataattctcatgaattgtaaccagtcacttaatttaccaaagctctgtgcacatcctggtaaagcaaaagtcttataaaaaacaaacagttaagacatcagcattgccttttaatgtagaaaagatcttatatgtgaaaatattttcattatcatttattttatctcttctgtgaattcaaattcttaaaatctatatcatatacatgatatttacatattatgatatattacatatatacatatataatatacacatgtgtatgtatacacacacacacacacacacatatatatatatatatacatatatatnnnnnnnnnnttagtttccacttaaagatttttatctatcttgcctcagagcttttctatctttataaataaggtgtggaaaacgatctcttagataggaaaatgtgaaagggagatctcagattagataaaacactttctgggttaaaactacaatattggaattttcaaaaatttctacagtgatgcttttttggcttaatcaatgtgtagagaaatctttagtcatgggatatatgcataaaacacatatagtatcgggattagaatgccaatgaaatcctccagaaaaattacatcttattttcaaagtaaaaaggtaaggtagatggtcttttgtttaatctcttctgtgaattcaaattcttaaaatctatatcatatatatgatatttacatatgtatattacatatacatatataatatatacatgtgtatataatatatacatatatataaaacaaaaaagccttggtttgaggtgttaggcgtgctaattgattcaatcattcactcacccatccacaaaaccatgtgctcccttggttctaatctcactgtccagttctggttctataagaatgtaaggaatgttctggcatctttctggtaatagtgagggaagcaagcttgtaagaatgattgtagcagagtaatcatagtgagcgccatctaacccttgtaaggtaatgagaaatgttctgccttccttaaagaagacaatttggagccagcacttctggtcacctttatataagattttccattcttgtgcttctcaattattttttcagtgaaaggaatttttagaacatttttaccaagtctacattatgggttttagtattctgcctatattgcacagaatttcaggcaaggaaggatcctatctttcagtttgaagcatttgcttacagacttataacacccctacccttcattcctatccagagtatgcaagaacaaaacttatgaggcaacttgaggtggggaatgagtctccttggaattctgtggtcctgctatgtttttatttctgtccaaattaagaaaccaagtgaaatacatattttaatatatatgaggacaactttgaatattatttctcctccagtccatctactaccatgtttttgaaccaggatttcttgttagtctgaggctgactgattagatttcttgggttagctggtgagcaatccagtgagctcctcctgagtcaaccttcccagtgtgattacagatgtttattgccataattagttttttttaaacatgtattctaaggagatatgaaacagatcatcatgcttgaatatcaggcactttcccaatacgccatctcaccctgtctctaacaattttgtgtcgtgagtacagaaaagattgctttcatgatggggttctacttcataatatcatttggtcatttaaacatgtcacagcatcagttgtttcctttaccaaactctacacatactcttctgcgtcctactaggctccaactttatgtatattctctagaaaccaattttagaaaccacttttaccaaggaccttgcaaattcagactagccagaatccccaatcctgaatatctggccaagccatcaagtagaaaccgccagttgcatttttccatcagtaaaaatcttgtgtcataagttacaaaaatttccctcaagtctttgtaatttttctgtctcctgacatgattgaatcctcagctacaccctcttttgttacaatcccaacttctcttttttctatcagaaattgtggcaaatatatctcctttactgcaaaatttcattctagtagtctatatatatgtagtttttattctgaatttattcagaatttattctgtctaacaagtttctggaaaaaatgaataactacaggtgataagaagcttttatgggtgctgtggatcttataatgtatagtccccaaagatctccttatcctgtcctgggacctgggcaggtgaccttgtgaggaccacactcagagtggatttccagccttcagcattctcttttgttatctctcagctaagtttaagaatcttaaacaaaaaggtttgagttatggaaacattattattgagccatttggtattttgaagttggggttagtgaagcatattaggtcaagcaatggatttggatcttgattgaaattctttctcaaatttaaatgtttttagtttccactgggttagttcctattttctcaaatttaaatattcttgtttctacttctgtgaactttatttcaaaatcaccattgtaatgagttcatttcctataacaatatttatttatttatttatttatttattctaaagaaacgaattcttataacaaaaaggaccaaattttggttttaaaacatttcagtcttattccatatgaagagctattttcttatattctctccataaaagtgtataccaaccaaccaatggtatatactatttgctttgtgttgaaatcggtaagctaatatttactatggtctggttaaattgagtttctattgaactgttaatattttttgtactgtaggtatggaattcaagccacacacatgcttggctatccctcattccctgagctatgtcagaactcatctttataagctgattggtgagagaatgatgagacataccattcagatgttctctctttctatcattgtaaggtaacatagttcataatatattgttgtcacttagtgaattaaaaattagtgatttaagaatgatccatcctatagcttcacccagcagctggtggaagtggaagaagacacccacagctaaacactgaactcaactggaatccagttgcagaggaggaggagtgatgagcaaaggggtccagaccaggctgataaaacccacagaaacagctgacataaacatgggagtgggctaggccctatcccaaaggatatgacagtctctgaagacccccacctatagaaggcctcaccctccctggggagcagaaagggtatgggataggtagcttgttagttgggggagggcacgggataaggggaggcagagggtactgggattgacatataatttaatcttgtttctaatttaaataaaaatggagagaaaaataaaataaacacatatttattttaattcataccttgattaatgtattttaaaccttgccacatgccaagcatggaggcagcttcatgcttaaatactatagaataatgaataaaattttcttataataccaaactacaaaaaaaaaaaataatgagcattgttttctgtttgacccacactaggggttttagacattatgtaataattctcttaaaagacttgtacaagtttccttgttactgacactgatctgaaactggattaagcaactttcagaatatcaccactggaagatgggatagcacaatgtaattgtagacttgatgtcttgacagaccatgtcaggagagaaagaaggtatgtccaaaagttagagtgaaaaatattaaggcttatcttagattgagttttaatataatatatatatgtatatatatgtagtatatcatatatatatatatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatgatactttttaatgggccattttctttcctgggctcaaatatagcctttaacatttttgctatattaggtcaaacataagtatctaacatgtgaggatggtatcacaagctatcatagtataaataaactataatttacttagccatttgctacttttgagcatttatgttgcttctaatttttgacatcataaaaagatgaattcatgggatgcttagatcattttttctttcagatatatttttagaaaaagaattttgggactaacatatttgagtataatgtctgataaatcacttaacccttgtgtacagtaagaaatctggtgacccttgctaaaataatccctggtataaacctgacccaccccaaaccctacaccacaccatggtagatctaagattctccccctgtaaagaaaaggccagaggtgatgggttgtcaccatggatagagttatattacaatgaaaggattgcttctcagtgtagtttaggtccataattagttgacatctatttaagaaaaaaagacaggaaggagagtaggcaggaaggaaggaaggaaggaaggaaggaaggaaggaaggaaggaaggaagattagagaaagggtctagatcctgaaaatttctgggtaggcctaatttaatcaagtgaaacatttaatgagccctccaggctcccaatcactctgctaacttgaccaaaacctgactgacagatgtactaatgcttgtttgtcaatacttgggggattgaaaccaagctttgtaaatgttagacaaatgctttaccactgagctacagccttcagtacacatgtatatataaataatgaacttcaaagaaatatgtttatttactcaatgtcctctaacttagctgttcagatggagtttatactgaatttttctgcctccaaaagctgagctctccacagatatacacagaaagtaagacaaggacccaaacttagagagacaaaaaaaaaaaaaaaaaaaaaaaaaaaaaaaaaaaaaaaaaggaagaaagacagaaaagaaactctaagaagaaaatgaaacagcagaattttctactatataactctgtaaaacatatattcaagttttattttcattttaggctaaaacagacttcccagttaaaacaggtgattatacgtttatttgaataataagaaaatgctttgggagtagttattgcactgaaaaggaatttctgctaaaaattgtaaagcccaaaatctcagtcagcattgacaggtctacccaaagtgagcagactgaactcaaggtcaattctagatgacaaatcttatgtaggaaggcaggactagagtagtctcatattctaaaatctaaaagatacagagagtcttaaatttcaaataattatttttaattaaaggtgtagctttgtgattgtttctaaggtaagcgcacacgtgcacacacacaggaagaattttcggacactaggtcatttatgatctggtggaaaatgctacactatagtatatttaataatattaagcatttggcatatgcttgtggaaaagtatatttgaagctggtaagatacagtaacttctttacatattaactagacccataaacattattggaaaaagtgttcttgcatatgagtcaagtttgctgagtcatctatacagaagtttgcttgacggaaattagttaacatgcaagatgaagaacggaaggcaagtttccatcatcttaactcgattaaccatcatcattatcatactaatatatttaaatttatcccttacattaatcccaagtgtgaattattcatggattcattaaagtagccttattttttataatcacacattgaaaaacataaactaattcatcaattagtagtaaatttctacttaaacaacatcgaagagtgatgaaaactcacatgttggaactagtctattttattacactttccagaagatgacattagcttcacttgcatacattgccagagttgtaaacatgttcatttaaaatagctatgataaagacacagatttgttttaagagttttaaaaacataatgttttctttaaaggtgttaatatggaaaactgaaaatagttcattggtgctcatgttatgtttactttgcaacatttaaaaatcgttcaccctctacattttgggtgattaatatggagctgagtagaagcaacagacctttgtaaagaatgaaccggggttttctgctcatcatttcccaccaattgtttcaggaaattataaagtcagaagacagaatcatttgcctgtttaattatgaattcaccaaactttaaaaatatattttgttttacttcttgtcattagaattttacatgtatattttgagtttctgctctgatgtatcaaattgcttagaaactaccattctgtcttttcaacaagaaaagcacaacaaaggaaaatcaatagtttctctttgggggtttatgagacaactaaattctctgttcagtctctcatccctaaacctgtagataggtaaacatcctgaactccagctgagctctcagttggaaaagaagatactggaaccataaagtgacaaggccactttagcaacaattttgagaaactgttggaggcaaattgtggacaaccacaacaatgaatgtctcctctgcacctcatttgtgaagagcctccacacctcttcactgctccactgctgagaaccctgtcaggttcctatagtgatgaaatgagaagcatcccctccagtcctgtccttactgtctctggcagaagaaagatggagtaattatgaaaaatacccagatccctcaaagtagcaaaggttcatttgtaagtttttatctttgttgaagggaagagaagggcaaaacgccgagtcatctgtcatcattggatgtgaactgtctgtccctcagacatcattgttttggagtgaattgtctcccagacacttgtttgggtacttggttgcctattgtttgaaagcattacagtaaggattcttcctctgagtggagacatgctcttgtctccttccttgagagttaatccagtttgtcagatcaatcacctagccataggaccaccgcacaggaaggtgggttcacattaaactttgctaaagagatagaagtaataataatcttcttgatgataatgctcatttccttcccagaatccccctgtgtagaacctccagagtcaccagtagattctgttgggtctgctcctctttctactttgtggctcagaaaggcatagacctcatcactattgcttctcatctgtctttttctttgagatgtttccagagtctattcatgccttccttaacactttctgcttcactaattttttaactctcactcccctagccaccctgtagcttacttgttcagcatgtcaacttaactcttaactcactgccttgtgggtttttttttttttattattcgtttttgttttctcttctccttcctcctccaggcagcctgctctattgctcttcttgtaaactgtaacaaaattgtcctggagattccttttgagtccattagtacattaatgagagtaagaatccaaagagggacccgatttacctggtaacatgtgggaacctctggtgggatagttgtaaggattcagacattatgctggcctgtccctgttccctgacagaatgcactaaggcattaccctggtcagcccagggttccatgacaggtgcaaaggacccctttaaaagaaagaccctgcccacttacacactcttgctctgctctttttccccatggtggttcccctggggcagacagaactttttctgtctccctcttcttttgtgtcctctatctgtctctgcctctttacctcttttctcttttctttcccctccttcctgtttctaataaaatttctcacttaagctctgtctgcctgacatgtttgttccctgtctcagtcaatctcacctgccttggaatcccccaggatccccttggggctttatcataacaatagccccaattttcagtaacagtagcactgttttaggaggtgaggcctagctgagtttctaggtctggctaacccccactcttcttctccctctctaactccttcctgactgaggatgtgatagacagctgcttagttcctgccaccacagaacgacttaccacagtgatttctttctgctgctatgatggatggacagtctcctcaagtcctgagccaaagtaaacctttccatcctctagttgcttttcctcaggtatttgccctcaccaaagaaagacaactaacacagtaaccgaactgctgtagaaaagtggggtcattgctgttgctgttttgcagaagaatctgggggttttagacaagagaattcctagttaacaataaacagatattaatgtgctactctggtagttcagaagatcagtatgtcaagagaaatgtggaagtaaaggccaggccagttagatcagataatgaaatgtcttagaagccattcctgttatattctggcaaagaaccaggtgtgttctgcccacatgctgagaactggtgtgaagataaattcaaaagacatgggctgaaatgtttggcagaggaaattccaagacagcatagtattcaggttgtggaatgctttggctcttgtgtttggtaaggttaagtgagaatgcaagcaaaaatggaacagaaagatatataaaggtaacctggattggaatgaagatgggagtctttaaaatcagcctgcctgcaaattgctgtaacaattaaagagattcgagtaattaaggaggattcactttgcactgggacatcaaaaaatttaccctgagggcaagagcacacatgtatctcacacctgggagtaacaatggagacccatttaaatggcattcacttgtaaatagaatacctgagtgaaaagagaatctaggactcttggtctgtaggactattctaggaactttctgagggttagccaataagatactcctgttgaagctgtgattaaagggagttgaactacatccctagttttctgcagagtgtggtgtcttctctgtatgatactgggttgaggatagcagataggactgaagggctcagatcctcacccagctccctactttggcagccatgacaggctgcagaaaagacccaggaagatctaggcctctgactcagcaacatgtgatgagcccccgactttgcccagcctttccctagtcactaggatgacaggtaccccccaggtggcaaggaaccaataagacgttagctggtgggctctggatgtgctttactggtaatagtggattgcagagcatagcaactgccccgagagggcctctaggcatagcaaccttccttcagctgcatttgaccaatcagcacaggacaggttgaccaagcccagaggtgcaccaatcctgagactgttgctatgcaaccagcaaactcacagatgtgccaccttgctctaccccaatatattccctgcccctctgctgcttaaggtcctcctgctttatccactgtgttgaatgcactggggaaccagaattgactggtaaaattaaagactctctgcttttgcatcagattgggtctgttggtgattgagagttttagagtttgggcctatcaggggtagtgttagctttccagtaaggctgtggaatgtttataacttttgtgtttggtaagctttagtgagtattcaaagcaaaagtggagcagaaagcacaatcatcatttgtggttttgtttattttagtcaaaatagttctcaaagacctacaattttcttaacaaataaaaagcataactatgcaaaatttttctatattccttatcatgttgacagactattcaaaaattcctatattgtaatatagactctaggaatatttactaagggaaataaaagcaaagaggttacttcaagtttctacaggcatcctcttaggcagttgggcctaggtgtaggtgttttagtgctacctgctgggtgtccttttctattccacaagctgtgcttgctttggctgccttaggatctaaagaaaaggcaggtcaaggggaagaagaaatcaagccaggtctttagcagcctgcacctcctattgtgttccccattagaagtctatggcccctagggtaattctactgtttcaaagtccagcttttccactccacacacactcactacccacttccctctattgaaccttactctgcccacagccccatcccaagatgaacagtagccttccaaggagctgacatctcacctgtatccaacaggatgtcgctggctagagttcaaccagcccttcaacctggtggcttagccttgcctgatttgtccccacctttcctgtccattaagcttcccatcaaattcagagagaaacacacaacagagtcttggctagactgttgtttatttcccacagacattcaaaaaacaaacagcctcattcttctttcaggtgtttatttcttttctaagtaaaagtttttattgggaaaagcaagagtcagcgcccagaaaaatctgtattggtgtataaactgaacttcagaagaagattaattcttttaccctgatgaggacttccgtaagtacaccatctctcgaatcccagctttgctttaactctgcaaactcctagtttacatctgtgggcaactatgtactaagaacagaatgggttatatcccatcaagacctggagattatcatttttaatacatgaaggatactttaacataagaacaaaatagtatcattagttatatagctattttgataatatctaattttcttatggactctaccttgttgtactggattggacagaattattgtgcctcataaagctatcaagttaatcagagtcatagatgtctgacaggcaaatacaatgaaaattattgttaccaacatcggagattatggatccatacttttgcaatttaatagttataatctttcaaattagatgagcagtgttatctgccttaataagatttttaatatcaaggtaaggattatatcttccacatcaaaatatactttgaaaaaatactacttgggggacccctatactataaaagtaaaaatgatcttacagtttttttatatgaaagtcgaattagaaactgcatttacaagccaaaaataatttaaagcttattttcaatcacattttatagcaaactcaaagcactcagtccctcttaagggaattcattactctggttatttctctactcaacctgtcctttcaaatctccaagaaatggaagaacaatttacagcattaagtgtgtttactgagggcatatcaggaaggcttgacctttaactgcagctttgtactcagggctcatgactatttcatctcacaacagagcaagaaaacataagagaaatcaggagcaacaatactaagtccatggccccattctcttgtggtgtagctaatcatttttattttagcttttgatgacagaattgaacactttatttaaaacgtattttgaatgacctgccacagctttttattttattaagaactggaaatttcttacatctttatgaagcagtattaaaaaaatctttttaggatagcaaattttgaaattaagggataaatgataccagcttctaaaagcattgttttagttagtgatcttaggatttgcaagtataattttcactggttattaattgttttttcttaatcccaatacagctcaggatgaaatctaagttagttttagcaatatttaaataataaaagattctatttttagagattgactcactgcacacatcaaatcaaaacataaagaatcatcaaaggctggtttcctgttattcatgtactttaattataaagtatgtatagagatgtaaaatgtacctattacatgtctttttgaaagtataaaaagatcctgagacacaattttcttatttatttaaaatgatatatgacttccagagctgtttcttttatggctttgaagactgctaatgattttttcttatctcctgtctgattgggcaggtgtcttcattgtacctacttcatacatgagaaccctgcttggcagagtttggaaaggtttatttaactgtctcctggatagtcattgttggagttgttggggctaagacctgaagcagggtttatgactcttaggaaaagattctttagttcccacagacacttgcagttagtaaattcagttatgtaaggatgacatttgcagtgctatagaccttgacctgtaagaagacagtcagaggtacatgtatagattgcttgctatatacttggcattttgcttttttggtctaaacacatggagacaaagccatggctttgatcttaggcagaagacagtgaaaactcaagtaaatgcagtatacagtgttataacgaatatcagataattaaagactatagagaaagccacaggagggatgaattttccaatctttttgagtacagagggcttcacagagaagaagatgtcagaactggaattttttgagaccacatttttttttatcacgtgtaatgtgtaatatttgaacagtaaattatcccttagcccaaagagaaggaagttaaacatgggtgcacacattctctctctagttcttccctggacaaggtacttcttggaaattcattttattagttggtaatgaaactctccatctaatatcaaagacaaaatctaggcatgctgagtttctgacacatcttctatcagtatactctttgcatttttctggccaaatcttgtctcagtcaaacattgtgttgcagacatctgttggcgtccacagtcactaccactgcagccatctttcttcgtttaagtctgttcccaccatgtggcctgaaactccttagcaaatttccaggacctttgagataaaaaccagtttggttcttaggatgaattgatttaaaaagtaatgtctagattaatgctagttattttggaaagaagagtatatttaaatttagtttgcaggattttgtaagccttgttcagctcctatgtgtagccacccccacaatgcaaaatgctatatattattcattgattatgtaatgcacttgtacaaaaattaaaaagaatataccaacatatacaaatagtatgtagtaataacataggtcatagtgctactttattatctttatttataataaatttttagtctatctattcacatttgtccttcatttccaaggtattgcacaaggaattattaccttagttttatgactggaatttcatgtacttgtagagttaaagcaacaacaaaaaaacaaaacaaaacaaaacaaaacaaaacaaaaaaccttacccagtatcatgtagtaaaaagtggtagatcagagccacagagccagatctgaagtctgcatgtttctgctctagcagtctgcatatttcctgtctcctgaagttcccatctctatatgtttactgatcgaagtacccaaaaggattcattataaaatttatcacccttaagacagagaagcttcctgtgtctgcattaccctgcccttcccctccttgccactgtaaatatactgaggtttctttaaataagctttcacgacttaactaagagataatatgtcattgttaaatttttgcttaaattagaaataaagaagaaaagaagcagatgagacataagactaagagacatattagacatattaatcagcttattataagcctggcagagtagggagactaagagagaagagaaacatggttaatggctgaccgccatggcctgatgccatagacaatcagagagagagcataggtgggagaagagaagagcagagcagagagagtagagagtagagagtaaaaagagcataaatgggcaggggtctgtcttttaaagggttctttacacctgtgtgcagactcagttcccatggaaccctgggctgaccagggttctgcctgagtggattccgccaggtaacagggaaggccagcataatgcttgaacctttcagtcatgggtcccagagaccattgcttgttatttgatctctcagggtgtcctagtggaaacactcaagctctgtcagaactcggctccttcagaacatgtactgcttttacagtcaactgtatcttcatgatgttttacaaacctagaaactgctttcctttgaatggaatggagtaattcttgtagatacagctttccattggctcttactagaaatgtgcatgtccttgagtgaatactaccaggaggagattaaatgctaacaatgtgaaaggcagtataaacaaaacaaaagtcttagtaacttttcaagggatttgtgagggggattggaatgtgaaccagctattctttacaagtcatggagaagtaaggttttaaaaagtaattgtgcctttgttattaacactattattggtttatttcctattaggttgcttattatattgccttttgttttatttatttcatattttatagtttcccatatttatgtttataagctctttcattttctttgaatatcttcttttagaattttctaccaatctgaatattcatttaaatgtgccctttatttataaacgatttgttaattatatgtttcttaaatacttactttaattttagagtacccctaactatggttctactcatgatttttttcaagtggcaaaattcaaaattataatcctcttttaatcaagtaattatttagaagtatgttttgctattttataagtataatatatttagtatctaaaacaaattacaagcaatgtgttgatttccacattttgaaaaaaaatctggatgatttattctgagtctatgcatgtttactttataaatatttactggaaattaaaaatatatatgttatgtggcatatactaatagtgcattatataattccacagaagtgtccatatgtagccttgcatactatagtaaagattaaaacacaaagttgacatttgtttacatatatatcactcttttttgctacagctctggatctatttattattccattgtatgattctttcagttgaatctgttttgttctatgaattttgattgctaggtaaagcttcttttaattatgctgctgtaataacatttttgaaatacatcttttatacggcatgtataaatgcatgtatatgttgatgtaatgtgtgttgtgtaaatgttcactgcattgtaattatcactaagacttgtaactgtcaataaaacaaggtattcatcttttccatattttacttttacctatagtttataacaaactattcccattttgctttattctgtttcacttctgggttctgtgtcagattctgtgaagggccaaatcttatttgcctacctgccatgctgtcttgtgccttgagcaggcacagcacacagcatgggcagtgagtgagtaaatgaatgaacggaaatgggttcagatgaatttgcataggatacacgtgaagggaagaacttagtgggaaaacaagtagagttcattttacacacttcactgcactaatttaaaaatgcatttctaaaaatatataaattgcaatcaaggggctggggagatatatcagtggttaagaacacttactgctcttatagaagttgtgggtttctttccgagcacccatgcagagctttggaacttcctggaacttccaaggcatctgatatagttccagggcacgtgatgctgtcctctagctttcatgtgccacaggcacacatgtggtatgtataaactttcaaaaaatgttgcatacagatatcatcaaatcagtgatcagaaggattatttacttgcccaagaaaactcaagtggcaaccaattatagtgagacacaacttaaaagttactacttcttcctttctatggtatgtattcatttatgtaagaaacttaggaaataattgggtatgtgtgactgataggagatatctgggcaatcatggatttcttccacatatacacacacaaaatcagtttaaaactcttggaacatttgctaagttattagctgtttgtttaaaattaaactaattttaaagctgacttgtaaaacttgggatttgtatgtgttactgtgatgttttaatacacgtgtgtaacacaggaacatgtatctctgcaaacagtgttttcatttctttatagtgaaaatcttcaaatttcttctagataattgaaatgcttagtacattgttgttgcacagtcacacacagagcaatagtaaatagtaaaaagaacttcttgctgctgtctataactcctacccattggtcctcttccctgattcagcaatcaatgtttatgaattcaaacactttgtatcctatacatgagtctcaagggaccagctccccattgcagcagccataacagccaaacacatgcttgcctgaccttgccttggtcactaggagctcagatgcctgcctcatggcaaggaaccaatcagaagttagctggtggtgctatgctttaaggctctgggtgtgctttacaggacaagtgcacagcaatgacgtgcagagcatagcaaccaatctgagagggtctatgggccatatcaaccagttgaccaatcaacacagggcaagtcctcattaaacaactgcaataaaacctcttgcttttgcctccacctggtgattggggtggctggtgtcctggaccgaaaaactgggggcctgagcctctgggggtctttcaagtcaaattgtgaggtatttctgttttgatttctagtttctaaatcttaacaggattatttgttttcatgtgtgtaggacaaaagttcattttaatacagttttcctaaaaaaaacttttagcttttaacaaaataaaaatggcatcttcatcatatttgatctttaactgcattgaaaacctgttcgaaaacattgttaattttcttttttagtcttaccttgtttccagctcttgtatatttcatgaatgataccactgtgtctgtctgtcatgctgttccctgtattccaaacaattacatcaaggggttgttctactgtgtggtgaaaactggtctgtttgcaagatcataaagaaaataaaaatgttgcaactgacaggagagtttatcttcccgtggtctgacactcttccatggtatctgtgtgttgcttcttcattctgatcaaaggatgagcaatttgttttcattcctgggttgggttgaagggaccagcctcctgctttagcagccatggcaggctgcagaacagacatgtaggcctctgactcagtacatgtctgaccttgctgggcctgccctagtcactaggaggtcggatacgctcctcgtgccaaggaaccaatcagaagttagctggtggggctgtgctttatggctctgggcatgctttacagtacaagtggcacaacagtgagctacagagcatagcaactgccctggaaaggccaataggccataacaagtagttgaccaattaacacgggacgggttgtccaagctcataagctcaccagtcctgagacttttgcatacccttagacactcaccttacactgcccaataagtcccctacctcgaggtttctgggggtccttctccagctatcctctgctatgaacagatgaagagcccaagttaatatagttagctcgtcaaacaacaataaaagactctcattttgcatccaaatgtgtctcttagtgatttgggggtttcagattttgggcacaacagggtgaataatgtcactatggtactggagtttaagtgtctcctcaacacactgattcaatttcctttggaaatcatctcaaggcaggaaaagatcagtcctatattattatacttttagtttttgagtgactatactaagttagattcacatcagccatgcaaagggttctcctccctgcatggtcagcagcactcactggttttagttgtctgggtcatgaccactcttgctagcatgaatcaacacctctctgcagtttcaatttgcattgatggcttgtgaggaagtgaagttgttccacatctgttagttattcatgcattttctactgagggctgagcagttagatctgttgtcagttttcaaatctggttatttgtttggtttattgttgttgagttcttgtagtttcccacagtctagcagactttcactttgtaaatacttccattctgcaagttacctcttctctgcactgttcttttgttcagtgtaacttgttagtttgatagaaacctatattccattttctaattttcatcctagctttaaacaacaacaaaaataaaaacaaatgcaaaccacctaagctcatttggaatgcccaaagcatttcatttgtgttcttttagtcgtttcatagttcctgctcttatgtttaaatctttaatctattttaagcaaaatttcttgagggaagggtttcttttttctacatgtagaaatccagtttcaccagcaccattcatcaaaagacatttttcttgtttttggtggatgtttccagcaccttgcttcagactcagttgacttagagacagtgatctaccctctacagctatgcagtgtatttagaaatttacctgtcatatctttccttcttttttctttaagaagcttctggctatgcaccaattgttggacttcagtggagagtctcatgggtattttaagcaggatagcactcaatctgtagatcattttgagaagtaccctgctgagcaattctggctaccaaaatttcactaaaataatgaaactttattctcatgacatgattactatatgccaggcactttgatttgctaactcagttctaccaactgtccattagtgatttattcttcttcagttagatttagaaatttgagatacataaatgtgaaataaattatccatggtcacatgaatgtaagtaattgaaataagatttcaacacaggttatcagctgctgattctgagtataactatgtgaagagtgctttcctggtatgtttttaatatatatgtaatgtggttcctgttgcttttgttatatatagtccattagattttttttcatgccagctgggaatccttgtatttgctaattaataactaggaacatatactgcatagtgtgttttgatcatttttagatgatatcaacatcaaaataattttgaaaagagtctctcctattttgcctttgctttgagcgcttctatatttctataacctttgattaagttggccttcacattcctctctgtttgactaaacttctcacaggttccttcttggtgtttgtaccctgacctcccttttcatatggcatttattttagaaagcttgtaattgtaaatgctttctctgccctttatgagtctttctgaaagcctcttgccagctttacatccagggaatatctttttcaaggacctaagaaatatcgctgaaatgtcatcaggaaaacgatgctgttatctctttcttatacactcactgggaggctgggaggtgggcatcttaccaggctaaaggcaagagatgggcatatatctattatctatctatctatatatatatatctatctatatatatatatatatttatattttatttttatggtaagggaaagaaggtaaggccaagtagaacagctggcgcctttctctccttcaccctagcatttaaaaaccaggattctgttatcactgtgattcagcagagatggtctcagatgcagttctggcctcactcagaggcctcagataacatcttcgctgtgatttgacttttcctatacagtgattttttattactatttattatcattattattactattaaaagcatagatttggtgagtgtatgttctatatgtgtgagcctctccctccccccccctctctctctctctgtgtgtgtgtgtgtgtgttgtgtgtgtgtgtgtggtgtgtgcgtgtatcatgagttttctggcctggcaggtcccgctgcccttctctgccccaaatgaacatacagatgctatattaggtataaagctgttggcctttggttaaggttccttatgctcaattactaactcaattatatcaatctaagtatttctatgttgtcttatcttaagggggaatgccagactttcaactcctttgcctgacaaatctcaactgctcagtgtcttggcagagaagagaagaatatgatttcctgtttgtccatgcttatattctgattctgcccagctatgtcacttcctgggatcacatgatgactcctctctgcctacacttctgagaatcctccttatctcctagtcctatgtatcatactgtctggccaatcagtgttttattcaacaaccaataagacaaatatatacaaagatgaacattccccatcatatcctcttttctgtctaaataaaatgaaaggtgttaactttaacatagtaaaattatatataagaaaacagttatcaagtaaaaactatagttacaaattttgtccattaatatttagcaagatttaaagaaactgttctatcatctatactatcttgtgagtttaaagtcttatattaacttatctattattataactaatgaagccataaccataactgtctgtcttcaactcctctccaagaccagagagggttagtatatatattctagtattgacagagacatctggctacctgaacagtcacccaaagttcttctgaaatgttggggcatccatctttggcccatagaccatagtgtctggcagtcttctctgtgaagcaggaaattttaaactgtccacctgcattggcagtttgtcagtcatttttctgtttcctgcagaatgtctggcacttccatgaagcaggaacctctcaggactatcttgttttgcaaattcagcagtcactttcctgtgggtcctgcatatccagtctatcaaaatgtccaggcaagagcagtttcttgtgcaaatggctagtcttgtgatattgaaagcaaactttataatgagtttctttgatgcccatctttctctcagatgtaattggtgtggcaaggagcaattgtgtctcactgccatgaaataattttaactgccatattctgtatgtctttgaaaggtttgaagaatatctattcatttcaaatatatctgtttattctagaaaacctaactaacataactataattttgactattataggtaactatctataatatgtacttaattatacattacatttttaatgaactatataagtacaatacctaaataagaggagaaatatacatgtcacaaaattgaccttaattttgtatcaataaatgagaatccataccaatacaaagtattcatttctatatcatttccccctttttctttaggagaagattgactgtgatcattaaccatttataataaacctcatctaaatgaaaacaaacattcataaacaatatttaggaatgtgggcatccttctctccaaactgtgttcctgctgtttgaggggcattgactgtactatgggatcatgagaaaccagaaacctggccaaatctttgttgttgtagtctgcaaggctgcattgtcttagttgttttagatgctggatcaactgggacactgattcaggggtttttgcttgatcaaaccattttagtgtgaaaggaatccatagcttttcatttttttttgtggaaacaaaaataaaatctcttttacaaagtaacatggccttaaatttaaattttgaagtcaaagtgttttcaaaaatatataagttggattaattcagcagcatttatagtcaagtgtattttagtagctgtagctctttcctcagcaatgaaaacatttaaagacaacacttaacatacactatccagactctctgtgtactttccatctttacgtggcttgcttatttatttatttatttatttatttattatttttactctattccgtttacctttattttttccttttatgagcctgggtttctctgtgaaccttttctgcacttgaactcactctgtataccaggctgtccttgagatcacagagatctgcttgcctctgcctccctagtgctgggattaaaggcatgtgccaccatacccaattactctattacttttttccttttttaaaaccactttatcctgtttctctcacaagcctacacatattgttaaatacctgtaatatctttagaggttttactttttacctctgaatctgtctttactgtatatgtttatctttttctagccatgagtcttttatctgctaaacaacaatgctgctggctttcctatgtggcaggtgtaagtttactgctcaccaccttggtcaatgctaccatcaagcagcatgctacctgcttgagatgtggcaactgccagctgctcatacataccattcttgtttggtagtaaggccttttaaaagatccctgcagttctttttgttttttgtttgtttgttttgttttttgtgttttttgctgcttatgctgagtcaggaacctcccttcaaggagccctgtgagtccctgcttgactctagcaaaacaaagaccatcgaacaaaatgctgctaccaagaagccaagcttgtctctgttcttatatttctaaaacaccttttaagcctttgtcaagttttaagtggaaattcttgcctcacattgaggacaatattttttgcttgatgaataaaacactgattggccaggcagcatgttaggtgggactaggatacaaggaggattctgggaagtgtacgcagagacgagtgatgatgtgatcccaggaagtgacatagctgggcagaaactgccactagctaaccatagaggtctggaggtctgtacaaacaggcaggaagtgacatagctgggaagaatcagaatataatcttggagaaacaggaaatcatactcttcttttctctgccaagacattgagcagttgagatttgtcaggcaaaggagttgaaggcctagcattccccagtaaaataagaccacatggaaatacttagatttataaaaatgagctagtaattaagcataagaaactttagccaaaggcccacagctttatacctaatatagcatctgcatgttcatttggggcagagaagggcagcgggacctgctgggccagaaaactcaaattacaaaatgacaaccaacatggggcacggattcccacttaaaacttgagctgggacaaaaaaaatctcaggttacatatgtgtatgcatgtgtgcacactatggagccctgtggatttcagaagtccacatgccacaaccagtgtcctctttctaccatatgggtttcagggatgaagtgcaggttgtcaggcttggtgttaaatgcatttacctactgagccattacaccaatcttgcagtgtttcttttttgtttgtttgtttttgataccttgcctgtagaaaaacacaaaaccaagtaaatacactcatattacctggtttttttttttttgtatttaattcttcaaaaaatttattcatggttaccgaagacttcagtggagaagggcagggtggggactgaaagaagaaatcaagtgaaaaactcttttgtgtttcttttctaattctttcccttcaggggcttctttaagaccaacatttgaacaaagaaatctgtgctgtagaatatagtaaataacttccaatatttcttttttattttgaacccactgtcttctagctctttgaacaggtgagagcttggatatggctggggaggtccacacagtgtctggagctgacagttggggacatctaaccaatgtgaaaataaaatcttacagaagaagctaagaaagaaacattcaagaaaaagacatctggattcaaaagattaaaatgtgtcttcttatatacttccttaggcaataagacttgatctgtctccttgtttaatgggaagaacaaatttgagggtgaggcatatcttggggaatctcttcatacttcttatagccattagctattttgatggctacttttattttatcagaaaattctccagtgattttcatttcgattgaatataaatatcttcccttatttcttttctagtgggagttttcaattatctattattcactaagcatttttatatggctctgcattgctttcttttacttcaaaaataaggacagtgtgtataagtttgccattttttattttttcctgtaatgtttaaaacaaaacaaaacaacagaatatttgcatatttttcaaattactttgtgtgctctccaaagcagtgttaagcaaatcagcacatttatatagggaggaaataatatcctaaaatacttggagaaaactaaagttgttaaaaagcttccctgctactacatgagaaacaacaaaatccacaaaatgtaaagagaccataaatcaattaatcaagataatggcttcctttagggtacttgagcagattttaaaaactcatttaagtgttaaacttaaaaattgaataccctgggacaagaacatacatcatttgatcagaatgtgagctaactttggaacagaaaaataacacaagaaattcaccaaagcaatatgaaaaaatatttcccatgcatctgatctcaggaaataagtattacattttggtccctccttccctataaggcccaacaattccaaaaagtaaatagtatttggatttatttaaacacctggcaagtcctttcccaaattgtgtttgtcaaacttatatgaactccagtgtgcagttcaatatatgaatatagcaagagatgagtgttttgtgcacttgtcctttgtctctgggattgctcacttaaacatgaatatggtgagtatatgttactccttctgtctgtcttagcaggacagcaaaggacttttaaagcattcattataaataggagtttgctatgaagaaataactattgtattggcagaagtctttctagtccagagggattaagatgtgggtgctcttcaacagttctgcctcagattggtacagggagtgatttcctgccagagctgtcctgcctggaggtcagggcaaagcatcagcagcaacagatttgtcttcatgctcattccatctgacagttcagattagaaatatctaccagctgtttgccttcctacctttcttaagtttggtaaggtgacaagtagaacagatttatcaacattttttctagtgctaaagtgtcagaatcagctttccaaatatgacaatgacaaccacaaatcctagcttctaaaagacgtcaggactcccaagcagattgcacttgacatttttttaaaaataattacaccacccatacaattgaatagaaatataaactatattttcttgaagagtataggagtaaaaaacaaaacaaagagttatagtgtttgttgttaaaatatcaaacaatgtggctatttaaaataaaggaaatctattctgtcttcatgctttttggagaaaaacatttattttattattaattctgtatatgtgtgtgtgcctgtttgggtatatgcatgtgagtgcaggtgtctgcagaggtcagaagagggttccaatcctctggagctgaagccacagtcagttgtaagacgacgtgggtgctgagaaccaacctgtgaatgtctcctgtaagagcagttctcagtctaattgctgcaccatctttccagtcacctgctgtataacataacttgacagagaaagtggttgaggaagaatggggatacaggggaagttgttgaatctgaaatttgttttctttatgtttcttaatcttatggtctgatttgcattttaaaaattaaaaaaaaaacttgcctttcctatatgaaagaattcaagttacaatgaagaaatggttatatattatacaatattatacaaatataaaagattacaactgtttggagccattgaacagtatataaattatgagagatttaaagtatgtttaactcacagctaatatgtatttttgagttttgctgggtgcagtggaatcatcgatggcagattacggaaggattcttatggtttttgctcctttaaaactctctgattacaatgcctacctgaacacctttctgaggctaagttcaccacaaacagggatagtgctctaggcatgaagggatattgtgtgtttacaaacaacaatgcagaaagagagctcatagatggcatgtcctgaatgtaacttccttcttcctctaggaagttaccactagctaagtcatctcctatttgttatcacttcatcatcaaatcatcatattatacgtctatcaaggcatgtctcttgatcagctctgaacctttagtatgcaaccacttcacaaaagctccttagctggcaaccaaactcccaatcgatgagcctgggcagagcacagtatattcaaaccttaacaacaaagttttcttctagatgatggcagctgatgtctgaaatgagtgcagtataatgcctgcttttggtaacaaacaggcttgagatagctacattcgatttctagtcatcctctactcttagtgtagatggatgaagtctagagtgctatgagtcagttttcattcagaaagtaaatctgggctgtgttctttacccttgaggtggaaattcttcttatgtgtttggttatcatcctcaatggttgctgtcaccaaatatctgacaagaaggaacttaaggcaagaaagcttcaatttaatccccagtctaaggaggaaggcatggtagctgtagctctctggctgtaggagtgttcaccagctgcttgtttgcatttcagcagaccaggaagcagagaaaggggaacactgatgctcatatgactttctccagttccttttaattcctctgggtttccagcctttgggatgattgacccaggttcaatgtgaatcttttcttctctttgagaacactcttataaacacagccaagggtttgtctaactaatgcctgaggcatttctctatcttatcaagttgataatcaggttagcaatcataagttggtgtcttctagtttttccagagcattgaaaaaattgaaaaatatcagtgaaattgaggaaatttaggcaattcaattggaaatagacatcttcaaggaggcagttaacttcctgtcttgccctggtgtccatggctgtctcagtatctcttctccatctgaattccacacactttgaaacagaaaagacaaaggccataaaagcttggaggagggattcttccataggagtggttgcagtgatcaactaaatattggatcatagagtctcctagtctatattatttttagctcaaatcacattgacattgtgacagaggaagtgaaagtggctttgttacctctaggggacttgattattcacttaccagaggcagaacacagctcttttctggaaaataaagtcagaagaaatcttggagacaacatcctattggtcttcagaggcaccttcaattggatggcatttaaaaagacttgggacaataattcaggaagacaatttctatcatcttaatgatccctgaattatttcaattatctaactgaaccctcaataatacagtgcttcaagaaggaacagacacattaatcaggcatcccagaatgacagcattaaaagagatgttagaaaaaaaaactaaaacaaacaatcctttcaaatagcttggaaaaacattatcccaacatgaacccctactctatcagggagcaaatgtgctcacaaatcattttgatgtaggagaaagcacaaagctttaggggttaaagaaaacagtgggtctagctttgtgctttagtatatgaatgtagagtaggtttttaccttcaatttcctgatatatgtataatggaaaagaaaatgatatcctttttcactgtgttcatcagagcatgagaaaagaatgcgcacaaagcatcaaagaacctgcctgataattggtagtttctttctcagcctttgcatgcttggaatctgcctctgtcttcaagaactgccacaagccatatgacctgaaggaaagtacttaacctctctggatttcagatcctacgaatgtaaaatgagaactttggactgactgattcaaggtccctccaaggacattttccactaaaatatgaaacaccatggcggatttctaaaacactacctttgcctttgtgctctcctagccagctgttctcataggcttggctgggttagacataattactttttccctatggagtcaagaaacaaactaagtggcagtgtccttgaataatttattcgactcctagaattagtacattatcactgttgctatggaagaagtaatttacattttgaaagggtattttacttcttttatctctgaatgtattttaatccttttactacttagaagatgtgactccattattttatgtcaatacttcccatatcctgttatttgggtggggtcagttattatgtgtgatgcctgatgaggttagtgatctgggaatttaagtgccgatattcagttaatgaatggaagccagtctcagagggtgcatggaagctatcaaactagcacctcaccagcctctaaagttttgtttgctctctgttcatgagctgtggaatagtagtttgtatgtacacaacatttaataacaaaaagcagatgcaagctttgagaataaatagcactgtggaatgaatatattctatagtcagacacagattctagttgagacttcatcagctactagcacagaatctcagcttcctgataaactaatgtgaatttcagtttctttactacaaatggaggaactcatgggcatccaagttggttcagatattaattgagaccttatttgccacagttcctttaactgcttctctataccatttactgcattatttttagtagtaaggtcacttgttgattacatatcaattttaggacatggcttgccaagagttactaggcaaggtaaagtgatgaaactaagtgaattacagaaaaacaactagtaatgaacattttagctgaaagtttgtttgaccaaatgctgcagatctgatacaatggtaaagaaactataacagggaagagggaagcagaagacctttatagctcaggcttatcactagccttttaaatttacttttccatttaaattaacccatatttctcattttctctctgtcacatggctcatggcttattacctcatttgctacacatcttgcttcctctgcatctggattgcatctcctcttatacctttgcctcagctctttttgctcccagcatcctcttagtctggttttcctatctaatctcctcctgtgaagctataggccagtcatctcttttttagccaatgagagtaatacatattcataatgtacaaaaagattgttccataacatctctatcaatcatccctgctctcataaggtttcatatggagcagaggtgccagctgactaaaggaagctttgagaagtgagaatgagcatgtattgccttaatgcattttgtagctggatatgatctagattcttctgacatggatttaagatgactcattgaaaggtgtaggaaaactcagaagctaaggttagggtcttaatctggtagaatgtaagggaaaagagaaggttaggatgaattgctctcttaaacaaatggtcagttagaggcctgagctatactgtgatttacaattggaggtcaaaagttctaagtttgttcgctgtccagcggccactcttgttaggagtctcctacttccattcccactacagttggataaaagtagtatgagatttgtaaatatgcttaagagttaccttgcgatgttttcaagactttgttgttttaaaggtaagaagatactaagagaaatcagagaagttacacattgctgtttcctacatgttagacaaagatggcttctacagtgtacagaaaggcaagatccttagctttcattctgtgtgactcactgccctgcttatttcatctttcacaatgctctcctctgttcctactccgtagttaacttttatgaagctgtggcaaaatttgtgatagaaacattttgtggaaagaaatccttattttatctcacagttgcagagggttgcagtatggaatcacaacagggaaggcagagagcagcatctcaattcatgacagtgggagcttgcagagcaggtgcttacattatggtagaccagaaatcagagtgttctcaaaacagagatctagatagaaaatttaaaactgctcttagtcacccagttccacaagctagattcctacgtggtgtccattgctcctcgaaacctatcagttagagaagaagcattcaaagtatgaggtaacaggggacattttaaataaataccatgacattaataccggtttgctaatatcattttaattatctgccatcagaaaccttgtaggacccctcagaatcctgtgaacacatgacataataaaacagttgatgcatgagtatgggcactcttccttttctgcatgggttactacatttataactgttggaacgaaaattctctttctatttctaataagccaataagctctgtgaggaaagtatgtaacaagccatcctgacatgcttttgtttaaccaaactcacctaactcatggtagtattcagtagatgcttaagtgaatgatgatgggagtcaccatggcagnnnnnnnnnncacagtggcaggttttttttttttttttttgacatacctctcctttcccagtcacttaaaatcatgtgaggaaagtagctatatctttgctgcaaaatgaggattggttagttttcctccaaattacacttgtagatgatgaagctagcttttgaatccatgtttatctgacttcaaagtctgtgatcttcccatggcatgcctctacttcatctgagactgaagaaaggctttaattttgagggagttaataatgcatggaacctgaattgaatataattttaagcagttctcctctagacgaattttttattatccagctgtagctttgcgccttcatctcttatcaagaagaggtaattatcttcattagcaggcaacccctttactcccatacaactttgatgcagttgataaaactctacttctttcactccttgctctctgtgaactgctatctttgaaagctgtgggtttgcaaccagatggccaactattattcactccttaagctgctctgcagcaatgcattgtcaggtccatcagcagatagcaacatatgaaaacatattgtttcatcttcagtatctccaaatgtcgctttaacatttgttattctgctctggttcctaattaaaggcagctcatttctaattcccctgactggtatctaccatttcaataatgccctttatgtttgtcctagaacattcatcattgtctcgttaatgctgttgttttccaataaaatgctaactcacaaagccctttcttgacttttctatagtgtgcaattatattttccctttgtcaatcattcttttctatcttgtgctatcactctactctggactcacatgtggcgacatctgccatctgaaacttgatgggctttcttacctttttaagctctttatcacagtttatccctccacttctgctgctagtccaagcagtatctttcccacagctccaggtcgctgtccctctttgtctcctctaggctgtttatctcacacactcagcctgcccctctgctcaggttcacagaggtctaattcccctcatgccattcattttgctctcatattcattgagccgcttaagacgatcagctcgtctctgatttaatatctagttcttaattttatacctagaagataattctcaaagaaaatcattcttaccttctctgctctgtttgaaaggcacttgatcctatcatcccgacattgatctgaattttgaatttgttgccatttaaaataaattaaaattttctcttagcctataatcagattatactaacagcacgaatccacctaacttaaaaatctagaaagtcatttgctagaataataggtcaactcaaataatgccactcttaatgcatactatgggatgcatgtcactgtttccccaataatgatgctgcttctaatcataaaggatgtgtcgataagagaaagttctaaaggcacactgatgccaaaaaatttctctgaatgagttgcacggtaaagagggtgttggaaataaagaccaagtgccagggcccccagactccttttcttaccaaccactgtgagctattcataactgttgagggagtcagttggggaaaaatgaataagctctgttaaatgagagaaacaaatcttactagataactatatatgaataaaattgctttattggggacgaaactgggtcaaactgttttcactcaggcttgtgaaaacatgcctctatgtgtagatatatgctttgtccatcagtgtgtgtgtgtggaggggggcacatgcatgcacatgtgtgtgtatagaggctagacgcttcatatgtcattcttcaaatgtcaccaaccttagtttttgtgacttgagatttcattggcatgaggtagtacagtagctatgctgtccagagtcctacctgatgcttcttcctcagtattaggattacaaagctgtgccaccatgtttccccctcccccattcccttctagttgttttggtgttaaacatctcttctgggaatagagcttagatcctcagcttgtacagaaagttcttttctgactgaactgttttcctagctcttgcccatcattttgtttacctttcattcataaattagtgttgaagataaatgagtctattttattatgaaagtaatgtagaactaaatagaatgtagtcatcaaatcaacaacgggacaatcttatctggaaaagctttggttaacacagatttgccagaatgacttaggttttttggggggacatcatgatttgctgaaatatacaacagattataaaaatatgagatattgttcctctgtctttttttttgaccaagacaaggtaagattgcaccacaaatgcaaataaaatgtgagtccaccttgcaaaattggacaatgatgaagtacagagaaccaagaaaactggtcatggtataccacttctggaaaacaaattatgactatttactcattcttggaacaaatatgtctggctccctgacagatacaataataaacaaaactgaccctccttgatagataaaatgataagataggcagccaggaaacacaattgtaatgattggtgttacacaaactagaggaaattggggaatttataggaaaagcttactaggtttagcaatcagaggaggagagattttctgtgcaagaaccatggaatgaaatgaattttgtatgccaaggagatgtaaattattctaagcagatggctttgcattgtgtcatgtggacctgaaagacaggaagtatggtgagcaaattcaaggcaagacagactaagcagaaacagtagtgacagcagatactaacattctacaagccagtcactggagcttgaagtgaaccctagggaaaatgagacagagacttggcactgcacaactacagctggtggtacccactttatctaaataacgtacagatttgttcagtgcagaatgcatgcatgttctacaattctacactgataccagttgagtggccctttcagagatgcagggagaagagttgtgtcactaggagtcagtttataattatttatattaattttgtgcatatacatatgtttgagtctacacagaagctgaagaagcctctagagccagaaatataggtaattaggtactgcccaacatgggtattgagaactgaactcaggttctctagaagaacagcaagtaatcttaaccactgaggtgtttctccagcctcccagcttgtaattgtatataaatactcttatttatgcttggcatattggtgtgtatctgtgtgtgtgtgtgtgtgtgtgtgtgtgtgtgtgtgtgtgtgtgcatgcttgtacactcatgtgcacctgtgtctgtgtgtgcatgtttatatatgtgtatgtgtttatttattctcttttaagtatttactgtattacaatatctgccctgaaccaatccatttactatcagtttaaacagttaaagtcctcattattattggatatcttttggcatgaaggaagtagaaaaacttatcactaagtgaaggcagtttccaatgttggttaccccagtgaaaagacgtgagctgacatttgtattaattacttttattgtcactgtgacaaaatgcctgacaagaaatctcttgcaggtgggaaggtacattgttgttcactattcagagagtggaatttttcatggaggggaggacaaggcagtaggatcagttaatacagtggcagcaggtgaccgttgggaagattttaccagctgctgggaagtgaagaactcagccagcatgctgggctataatcttaggacctcctcttatgaaaccacatctaccagatagacccaacacctaaaagttgccacaacctctaaaatcaccaccaacagctagggtataagcattcagtgtgtgtgtgtgtgtgtgtgtgtgtgtgtgtgtgtgtgtgtgtgtgtatgcatccttgtgtgtgtatgtgtatgcatgtatgtgtgcatatgcctgtatggtattaattccaaccttaacaacattttttttgtgtagatttagatgatccaatgcccagtgtctggaggcaggtcattagacatagtaggcataaaatctagccatgatattggggctgaaagcatgaattttagagccttgaaagaaagtgtgtgaagagaagtgtgaaagagggaaccagaaagatttagggaaccaatatcagagggctttactgggtggttgaaggaaatgaaatgtgtatgtgttcaagagaacaactgaaagcagaatgaacatcatgacatccatggtattagttaagcttaaaagggaattagaactaattatttgttactgtacttaaacaaattaagtgtaatgattggctattagaagagaaaagattccaagtccacaaatagtccagccttaagtctagagatgtatcttgagtcatatacatggagccagtagagtgaacttactgctcattgtgaaagacaaagctagtgtcctccaaaagacacggatgctatttagttcatgtaaggaaaatgaagtgcaccaatgctttcttgtccagtgcaagtggggttttgtccatgacagttgttggtacaacaggatctgtgcaggaagatgacaaagcactgagcttcatcctgaatccctcacttccttttaaatgagtgggctgcccaactgctttttgattgctcccaggtaaaacaagtctatttactgacattggtaaatgcagaaaaatatagcctattcctgcaaaataaaaaaaaataatactttaaataggattttgtgtagtaaatagaatagaagacaaaactcccaaaagcccataaattgtttatatgcccacattaaaacaatgagagtttttttcttttctgatcttcctgtttcttccttcctctttcctcgcttcctcctatcctttacttcacagtggtagaaatcaagcctatggccttgtgcagtctaggcaagtgctctgacatgggggttcctctcttccattctctcatcctctcctttacctctgctttcttcttcttttcttaattcttatgtgagagtttatcctcattgtcaaccttactggatttggaatcacctaagagactgacttttgggcatatcatggagggcaggcaggggtttaaatgagcaagtaagatccactctcaataaggatgatagcattccattgtctaggagatggtgagcacactgaaacagccaattaaacaccagagttcttttttctgcatttcctacccagccaaaagtgagttatatctctcatagtatgatgatggacagcactctaaaactatgaactaaaaatacacccttcctcctttacattactacttgtttgttatttgatcgcagcaacaagaaaagcagcaagtgcagttagtataatttttaatctgctttttcagattacacatgtggtcttcacatctgtatattgcagggaaagataataatcttctaagattacagttattatacagctggtaatatattgtttagtcaaagagttacatagcagctgtgttcagtgtcattacatgggtagccatgatgattgcttcaagcagtgactacagagttatggagtgtctccaaatagacacattcaaatgccttcctgctnnnnnnnnnnnnnnnnnnnnnnnnnnnnnnnnnnnnnnnnnnnnnnnnnnnnnnnnnnnnnnnnnnttgaggtctgtcttgaacatacctgttctttccataacccccttttattggaaatagatgttttcctcacataatatttcctaatcagatgtttttctcacataatatatcctaatctttatttcccctccctctatttctcactggtttctaaggaataataatttaatttcaataaaataagataaaacaaaaactaatgcattagaataggacgaaataagcaagcaggaggaaaagagcccaagaaatggggcaataaacagatatagacacaaataccccctcatttgtaaatgaaggaatccaataaaaaaactaaactagaagccataacatatgaacccatccaggccctgtgcatgctacctcagtctgtgatttcatgtgtacatcagtcctgctgatttagaggatcttggtgtcctctatccccttaggaatttattcattctgccttcccttccacaagctccctgaggggatggggtgttcatggagacacactgttgagggctgagtgattcagatctctatttctctccatagtgtctagctgctggtctctgaatctgctcccatttgctgcaggagggagcttctctgatgatggttgaaaaaaggcactgctctacctgtatagcagaatgacatgataagtcattttgttgcttcattcctttagtttatcagtagcatttggttttgtcctagttccctgggctacctagtctcagattattggtcaatcacccagtttaaggtctggattccatctggtggagttgccttaaatcaatttagatattgattgataactcccacaagctttgtgccaccatttcactagcatatcttacaggcaggacaacattttatattaaagagtttgtagttgggttggtgtttatgttgctcatttagtagccagcagaataatttccttcaccaaagacattagcacattagggtaaaagttatatgcaggtaccagcttgatatctccatgttcagtgagttctgtcggtgttatcttcagcaatgggcctttctgtcagtttgtggagagaaagctacagacttgacaatagattgagttgtttgggcattctcaatggaacactttgaatactgaataagatttaatccaatccttgtactggaagcttcatttggtgatagatgtccagttggggctctgtctccctattatttggtgatttcatttagatcatcttcatatatgtatatattttaggaagcattgattttattaggattatatatgacccctcaaatgcctataattttagctatctctcactgtattctctcccttaactcccttttctacccccctctgcattttatgctttcattgcagttcctccatccattcataactaattattttatttccttttcctaaagagatctatctgtcccccaattctacaactaacctctgtagttttatttatcatagcttggttatcactgacttaacagctaatatccacacatacttgatgagtgcataccatatttatctttttcgttctgggttgcctcactcaggaggaagtttttctaggctgagtaatattccattgtatgagtgtaccacatagtttctttattcattgttctattgaggggcattttggctctttccaatttctggttattatgaatataataacaataaacattgttgagcaggtgtccattgttgtggatagagcatcatttgggtatatgcccaagagtggtaaactggatctagagggagattgattctcatcttcctgagaaactgccacatggatttctacagtgtctgtacaagtttggacttccattagcagtggatgagtgtttttgttactctacatccattctgatgggtgtatgataaaatctcaaagtagtattgtttgtgtttctttgatgtctaaggatgttgaacatttctttcattgtttctcagccttttgaattttctcttctgagaattgttatttatctctttatcccatttttagttggcttcttttttactgatatatagagttttgaattctttatatattttggatattaactctctgtcagatgagttagttggtaaaaatcttttcccattttgcaggatgccattttgtctgattcatggtgccctttgccttacaaaagcatttcagtttcatgagatcccatttatttattgttgatattagttcctgtgttgtgctctgttcagaaagacttgtcctgtgaccatgtattcaaggctattcctcactttctcttctatcaggttgagtgcatcttcttttatattgaggtctttgagaactctggaggggagttttgtgcaggtatttttgtgatctacttgtacctatctacttaacaagtactgttcgttgaggacgttgtaattttttcagggtgtatttctgacttctttatcaaaaatcaggtgtccataggtatgtggattcactgatcaatgtatctgtttttgtgccagtttcatgatatttttattactattactgtgtcatacaatttgaggtctggggtgatgatgaagcctaattgaccatgctagatgatctttttaatgtgttcttggattcagttttcaagtactttattgaaaaattttgcacctcttttggtctgtaatttttgcctgtaattctctttttttgttgttgggtatttatatggcttgtgtatcagcttgactgcagcctcataaaatgaattggataatgttcctttggtttctatattgtgaaataatttgaggagtattggaattaactcatgtttgaaagtctggtggaattctgcactaaaaccatctggcccttggcttataattttggtttggagagttttcatggctgtttcttttacaataggagataatctgataatctgattttagttaactttggcaagtggtacttacctaccaagaaaattatcaatttcatttatattttctaatttgattgagaataaatttctgaagtatgttcttacaattctctgaatttctttgttatttgttgttatgttctccctttcatttctaattttgctgatttggatatttttctctctgctgttaaggttaaggaaatttggataaaggtttgccatttttactgattttgttaaataactctttgcttcactaatttttagcttttttcctttatattttactgatttcagctgtgagtgtgatatttcttgccatttttatccctcttgagtgagatctttttttctagagcttttacatagctagtatgagatctcattttttctaagtcataggcacttagtgttatgatctgcagcagcagggggactctggtggatctcatggttggtgagagacaaccatgccattcaagtagaacacatgtggcaaaggtgggaaggaagccttatgggggaagagaatacagagaggaataaaatagaaaaagagagagaaaaaagagagaggtgaagacctgccttaatgggggaggggcaagagcagggaaatcttgtcttttaaggggaactcctgtgcctacttagagccagggtactgcttgccatgtgtggagggatgacacacttggccaggtccctaaggagaggggtgaaagggtggaggggtgcctggatgctaacacttagtgctacaaactaagaactcttggatatgcttccatgtattccaaaagtttgagtatgctgcgtattaattttcagtcaattaaagaaagtcttaatttctgtcttgagcaacttttcattcattagataactgttcaatttccatgagtttgtaagctttctgttatttgtcttgttgctgatatccagctttaatccctgctgatacttgctttgtgtccaaatatgtgatcagtttggagaaaagttctatgagttgttgagaaggtctaattctatagtatctgttagatccatttagtttataatgaatgttagctccagtatttctctctttagtttttctttgtatgacctgtctattggtgagagtgtggtattgaagtctcctaacatcagcgtgtgaggatcaatatatgacataagctatagtagggtttcttttacaaacttgggtgcacttgtgtttggagcacagatgttaagagctgaaatgtcatcttggtggatttttcctttcatgagtatgtagtgtcctttcctatctcattttattaattttggtttcaagtttattttgttagctggcaaaatggctgtacctacttgtttcttaggtccttttgcttagaatatctttgcatccttttaccttgaggtgatgaatatcctctatgttaaagtgtgtttcttgcatgcagcaaatggatgaatcttgtctttatatccattctatctgtacatgtctttattttggagaattgagaccactgatgttgaggggtattaatgacaagtgttcattgattagtgttattttgttgttgttggtagtggtggtggtgatggtgtgtgacagtgtttgcctgttttgatttgttggtatgttattatagggattagtttttttcttatcttgagtgtggttagttgttacgataaatctttccaccaaaagccatgagccccactgccatgtgtgcgctctacaccagctgcccacatgagttagggcccccattactgcacagagagacttgtattaggtacaatgctgcttggccaatgactaggattctcatctgctagttcagtcttaattatcataaatctatatattttataagacttatcttatagaagatgccttctgctggcaccctctcttgccttgtgccactggaggaagagcagagaggaaaaagggacacttcctgtttcttctttcttaaatatgagtctccttgctatgtcacttccttcctggatcaccacttctctacttatttcccagaatcctctttgactcatagtcctgcgtaacttggtgccattggccaaacagtattttattcaacaatcaataagataaacatacacagaagtacattccccatcagttagtctcttttgcttggaattttccttctatgcctttcttttcttttcttaaatttatttatttaatttagaaataatcttacattcttttacttttttatttaaattaggaacaagcttattttacatgtacccagtacctcctccctcacctccccccctacccctaccaactccctatcccatcccaagtttatttttttaatttcattttgcattccaactacagttctccttcccacccctcttcctgtccctcttacctcccccctcatctttattattatagctctgtagtataacttgaaatctgaaatggtaatacctctagaagatttttgtttgtttgtttgttttgcttaggatcatttgggctatcttattttacatatgaagcccatttccctctccctcacatcttccatgcctcccaccaaccccccatttcacaccccatccactccccagggagggtgagaccttccatgggtgatcatcaaaatctgtcacatcatttggaggagggccttggtcctcctctctatatcttggctgagagagtatccttccatggagaatgggctcccaaagtccatttgtacagtacaccatttgttctactgtcagagttcccacagactgcccaggcctcctaactggcacccatattcagcgggcttagtttggtccactgctggttcccaagtttcacaactggggtccctgtgctctcacttgttcaggtcaactgtttctgtgggtttctccagtatggtcttcacccttttgctcattccccctccctctctacaactgaattccaagagtatgtctctgtgcttcaggatgaccccaattaagaatctaagctatagtggagagactaccttaaatgcccttcccctataatgagattgatgactaccttaaatgccatcccagagtcttcacccagtatctgatagagttagaagcagacacccacactttctacagctttatgtaactctgaatttgtatgtgaatatgatttaaatatgactttattttcatctgtcatgatagaaagttttgttggatctgtggtccaggtccttagggtttttagaggctttacccacaaagcaggtattttcctaatatgtctacatttaagtgttacttggtctttttcccttgaaaattttaataatctttctttattctctactttagttttttgattattatggcattctgtgtgattcttgtagctctataggcatctcctttatgctagggaaatttgtctctatgattttgctgaacatattttctgtgtctgtgacctgggagttttcctttctctattcctattattcttagattggtctttttatattgtcccagatttcctagatgttttgtgtcaagagccttttggatttaacaatttctttgaatgaggtatccatttattctattgtgtcttcaatatctgagattttttctttcctctcttgtattctgttagtgaagcttacctctgagtctgcttgagttcctgagttttgtatttcctgattttcctcactttcggttttctttattgattctatttccactttcaggtcgtgaatggttttatttgtgtcctgcccccttctgtgtgtcatatgtgtgtttcacagatttctttaaggaatttatttatttcctctttaaggatgtttttatattcataaaggatataaggttgttttcttgtgctgcagttatgttacaatttttcagggcttattgtcatagggttgctgggctctagtggtgacaagttgtccttgatgttactgattgcttttttatgctcttgtctaggcatctgggtctgggatgattgtaattctaggtgctgatttctagtctttgttgggtggctgttttgttccttgttttctgttgccttctctggttcttagaagagtgtggtggctgtgtattgcttgctagggaagtcttctgaaattctgctatgtgtggccactgaggtttcagggtaagatgtgtttccagatatttgtagccgacacttaagaactgagatggactaggcaggtggtggtaattagttccataggagggagtaaggcagggtgtttgaccatgttctgcttagttccctgagaatgggtgtagagactgaagggattcaaccacaggtggtctactcagagctggaaatgagactggggattggatttggaagagaggaatggagagtaaagctcccaatcttgtctacttgcttctctgtcaggcttttctggtgttttccctgtatttcctgctgtagttggggtttgcaataataggatgaataactaggaatgttggagaggatttatgtgatctgaaggagatggggcagagaggagaggggagtggcagaaggcagtctgctacagagttgggagtgaagcagaggagaggtaagagaggtgaatgtctgcagttgcactccctgctttcctggctggagtggcctgtgggttgacagagaatctctaccttctcttcataccattgcttcataaacattcttataaaaaggaaaaagtcatttctagatttgaagttattttcttaacttttatctgaaacaaatcacatgactttttaacctttgtactttcatgcatataagcgttcaaatatcttaaatcaccttttaccttggttctgtagataatgatggtagatacgggtaaacccattttttttccctgaagattttaggaaggacaatgctttgataggttgttgtaaaagctataactttcctacttaaaaatactgcattatgtaaagtggtatttatttgggttctacatttaacaccatgcaaaacagttcccctagagcaatattttccttgagaagctacggacagcagaagttctcagggctgatgaactgctttaaacatttcagttttctgctttgtgactcctgctgctccatttttcagaattcatttagttttacatcagcagtgtccattttagtacaagatgagaataacattcttttgccacatcatcaacttttaaaggattcatcttcactaataaaacaaagtggaggattgtgtcaattagctaaataattggagcaaagactgaacttttgtgtgccccctcccactgcccagcattagtaaggtataaattggcaaataaaatgggattcagggtgtctaatttcctgtgctgatatacctgtgtgcttttgaaatgattaccaccatcaagctaattaatgtgtctatcacctggactgcagtggtacaatggagctgttgcaacagggaccatggctctgtgaacgctcattttcatttccttttctggtctcagagtggtcaggggaccttctttgtatgaattcaggtggaatgttgctataacacaaaattaatcttgtgtattcaacggatttatgggagctctctgacttaaaattcaaacaagcaaataaaatctgtactcatggcacctgaactcagccctcccctagccataattaacaactaatgcatttgaactcatttaccactcatctgtagcatttagaatatttctgaagctgtcttaacacaggacagattactgttatgtttagtacctgtgtgttatcatttatttatttcctctttttgttgttttgaatttctttgtttgtagagttattaatatactggtgccagatcatttgaataatgattgtggtatgagttgtgttaatacttaaaagagtttttttcttccctctcatttattaaggccattaagaaaatgtcctagtagcattatcaagaaatagttttaaactggccctctattccttgcaatgggaaataggacattttcctataaaactctttgtgggaaatttcagccttaaaaattgaatttgaaggtctcatagattcatgtaccccatgataaaattatgtctgaagtgaaaaatacctaaaattggagataaaaggatgcaaaatagcctttgtatgtcattatcttgacaactatcatgtgctttgctcagtttcaatatttaataagtgtctaatttcttaaatatggataaaaattagaaacaataacatgtaagctactttcaataaatagacatgtcctcactgatttaagaatagtaattgggtgtagcacattaactcagtagcctagagcaattttataataatcttctaagggcttaggaaaaaaaccaacattttattactattaagatactgcagttactgcctttcttaattcattttagagagccgtcaataacttcactccattaaacgctgaatctaattagcttcaggtcacaatttatgtgatttctacattgtatgctatttccaatgcctagtaaatgttagctgtggcaacataaatacatgtaatctatagtctctcatggacaatctcttttttcctgagagagcatacttctcaaactgctgtttcagattgctctctagactctttggctttcatatatggagagataatgtacagttactaatactagagtgaacaatgagattccctgtcaaaaataataatttatgaaatggttgcaggagaatccaggcaagtccttttgagggaggcaccatgtagctataggtagcatatttcaatgaagatttcctgtggctttcctgaatgcttaattttctttgagaaatccatatttatgtataatgtaatatgaccatatttaacccccttttctccatccaacttttcctgggtactccaaataatacagttctctagctctacaatggcgaaaggctgtttgacttctatagtaaaacagggttggccaaaatccatgttgacagttgacagtttgtggactctgctgtcctttagttttacagataaaaggatgaaattttgttccttgactttttacctttgtaaataagaaattctagattactaatgctgtagtttccgtagactaattagaacttgtgaaagtgagtatagagtgagaaaaattctcttggatcatctgagttcccttaacaattattgcctactcctttacatccttttgactatcaggtaaaatatttgggaaatattcacttggtagataattatcactcactcctcaaaagcctgagaatgagataaaataacatctgaaagcccatttcaagattttcttgctttgctgtgccttgcctgcctgcactcctgattgatgtacttggtaactgcattgattcatggattgtctttggtccaccaagtatgaaatttcatatggccacatctacagtagaacatgtcattcaggacaactcagcatgtgatcctgggccatgatcactgaagtttagaataaaccatcttatacttgcattgaaagaagagctgtattttgtgttgacaccacacatatatgcttgttctaaggtaagcttaacttattaagaaatggtgaagtgttcatgggtattaacaacacacatttccttggaaaaaacctgtatgtcagacatgggaactacttggttatacactaaatggcatcttagtgcttctgccattccttcatattcagtgctgtggtctaggtatgtgctgttgaaatcatgtatgactattgagccatacaacattaaacatttgtgttgcaggcagtgaagcagagcaacagagaaaatctcaacaatgtgcaaacctttagtattttcaaaagaagaacttacgattcaaaatgcatgaaatttctacaagtaagttaggaatgatgatctagccagaacttcaaactaaaaactctcatagtcaaatagaagtaagttaaaaaagctaattagaataaaatggcaacttattatctgagaaactaaaattttgtaggaacatattttttgcttgtgggtttgtatgttttgataatattttgctaggttgcttaggctggcatggaacttcattaatggagcctaagatgacctctaatttgtgatctttttgttatcctggacccttggaaatactagaattaagggcttttaccagcatagccagcttacagaattttaaaaactgaataagtatgttcactgtatataaaggctagaaaatttgaacaatacagaataaggaataaattaaaaaacaaataaaaacaagtgacatttgcttgtctatgactaagaactgaatttctctgaataagctgccagcttaactgatcaatataaacaatctaacactacaaagatatgctgtgatccagcaatgtttaggttaaaactgacaaaagttacaaaagcattatacttaaacaaacaaacatcttatactgggatagctctaaggatatggtgtggcacatgtcctctgaccagacacttgttctcctctgttcccagttcctacccacttgcttctcctgagcatccacgatatagtgtctaggggaccaacacattggctctgtgaactgacaaggaactgtacatcctggaaaaagacccattcagaaaggaatgttacatgacagttggagaaagagaggaaccactgacagagtgtgataccagagatctgaagcaagggacttgaaaacagcactgataatgaatgtagcagtgattatcaggatcctggatagaaggcaacagttactggtctgaggggaaggaggagcaacagggcccaccaaaatagctatataaggctgaggcaggaacactaaagctgccagagccacctgccccagagtgaagttggagatccccaaggtcaaagaccaaaagttatagatcctgagataagcctacattgacaaattaagttagaggttggcttcaaagttgaactgtaatgtggaagtgtaacccaaataagctctttccatcctcaaatttttttgtgagtgttttaatcacagaaacagaaaggaaaccaggacacagacccaaggtgtggataattcagggagaaaacattcttctttggaaatgtaagcaaatactaccctcctgcctcccatgcaccaatggcccataaagaaatatactggattttttttttttttgcattgctcttataagactgctgttgtttaagacaattagacttgagttccatgagctaggatggctgagtcatagcctattttaacagggcaacaggcagaaagcaaggccaatctggagaaaatggcagccatcaaatcttgccaagcttcttccatgagatgccatgtgaaggaaatttgttgacaaaaatgtgcaaggaaaatgagatgctatgctgaaattagggaagagcaaaccaaaagcagaacagaaacacataacttgtcaactaaaatattggagacctatatgaaagagcgagaacttactattgatgtaggaaacaaagttgagtcattaaggccaaggccattactacagcggtagaaatcatgactgaaaaggaaatatataaaatcagctttgttaaactagcaaaaaattaaaataattttaggagtgggaaagaatattagaagcaataactgaagaagtgaaagtgattaagaactatgagactgacaccaattatgagctctccagtatggtatgccttaactgaatggacaaacatttggatgtggtgtgctaaatttcttacattttaagtagggggaagggtgagagagggagggtgaaggagagagtatgacctttgaaacatagaaaaactgatttagacttcttatttccaacctatgaaatagagcattaagaactgctaagcgaaaaggcctatagccccagaatcctcgtagaataataagataattaaaatgtgtaaggatttagaagagtatctgtcatctatataagttttctggagaaaatgtacaaatatacaaatatacaaaatatacaaatattttgtatatatacaaataaggggaaagtcctcaagattttaaagaacagaattaacacattctcctttactctctttcaatcattaagacaaaacacacaaggtgcacaatgagtagacagtatctgcttcagttttggttttaaggagccttggaatacaagagttataacctaataatgccttgtcttgaaggtgcaaaaccagtccaccatttataaatgtttacatgtaactgacttttaaccctgattgcatttgaacatattgtaaccaatcttatgatcaatttttctttgtgattttaacacagactttattaaaattcagggcaaacagttcaataaagtcattttattgattgaataggtaggtttatggcttatgtcacaaattgtacaaaggtaacaatgagggaaatcttaaacataactcttcagaacttaaaataaatgtgagaagacaaacaaataaagaaccagtgtttgaggatttgtttgggtattttactatatttcaactcttaaaacataatcactcacatgaatatattttatcaacaactgttgtgtgccaaaattgctgatatattatgtattttgcccaaattttagtgcacaaaatattggctcttttataaaacttccttatagttgaattattatggcaaatcttcaatattgactactactgacaaaatacagtataattattattattcaaatatttgaaatattaaaaaaaaactacttaagattttaagtattggacttgtattactccatccaaatataatgcatgaaaatgagaatgaatttgaaaaaaactaatcaagctaaaatgcttattaaaaagaaatgaaataaaaatctcattttttggaaaacataaatttctctaccctctgtaacgataactctttctaccagccacccaagttcttccaccatgctagggccccaaaataacacagagagtcttatattaactacaatgctgctgtccaatgactatgacctcccacttgctagctcagtctcaattctcaaccataagtattaatctatatatttataaagacttatctcatggaggacaccagtggcatgcatcctatcttcctgggatcacatggtgactcctgtctttactacatttcctagaatcctccttgacttctagccccacctatcttgttttcttattgaccaactatagtaagaaattaccagtacggagtcaggtagaaatataagggtatttaatagggaaaagccttacttacagagcgaaccagccagccggtggtagtctgtacagcaagaagcaaagagaaaccgaaaccgaaaacgcagtccccctactcactctgaccacgccctcacaagcccgtctcagcaaaatgagctgaggtagaagactactcatccatgtgtgatccagcgcagcagaaataagttgaatttagtgaatcaccaacttctctagaataaatgcagaagatgtggcattggcctgtttctccacatttaagccagtagtagcatataagcggagaacagccaaggctccctcccttctcttgacaaattctaggaccaccggtttccttcctagtgtgtacctcttaccctccccaacataaggttgctgggtgagtagtagctaggaaagtgcttgtggatggctcccgtctccagggaaccaaggagcttgaccatgtattgcttccttggcatcttgttgtattcatggctacagcttcccctacaaccaacagtgctttatttatcaaccaataagaccaacatatacacagactttccccatcaaccctctacaatttctacttctctgggaacctggaaagctcttaggaattgaaaggaaaaattattccactccaccttcaattttgtagtatttttaaagtcaattttcagtacagcattaaaattggaattcaaaacagcatatagacacaaagaacttataaatacatatagcttctacgaaggagacaggcaaagtggcattttaaagtagaactttatgtatgtaggttagaaatgaaggaatgtaaatactcttgttctgatttgcatccatttggaaatcagagctggaacttcataaatttcatattaaatgatacataaatatcataggttaaaggacagattttcaatgcagtgttatgctcccaaagagaattactaaagctagtaaaatgaacaaagttaatgctgccagtattatagaaacataatctgtagatatttaaagcagactctaaaagctcatgatattttctgcaggatatgtaaacaagtttctaaatttggaagcgatgttgtcttcacctaattttcttgaaagctttaaccagtctccagagttgaggcaccaagcatttcctgaatagaggtgccaatcatcctcagaacagtttgtgttggagactgtcagccatctcctctcacctcttcagcaaccagatttaactctgagaagctttggctggtattaagaaaagatgacaccgggtattactagatgcagcaggagacataggtgcatctctcaaacaatttgtctacaacccacatccaaaatttctgatgaaactaattcatagacatgcatgatccacacggaatgcatcatgaaaaagtcacagaagaaggtggctggaatgttgcctgtcccaggtcacttctgctttgctcaggcaaagttctcattcccagaatgcatctgtacaacctgaacttattatgcaaacaacattagtctacattatagattactaattgccctatttcatatgaaactttattatcacttccacataattctatctctcctgttgttcatttttctttcatttccacctttgtttcattggcttttcagtatctcctcccattatctctttaatacatttcccagacccacatacccagattgaagaggaagaccagtgccctcttgggtgggggaggtgataaatggtgccacttttcttccgtaactcttgccctttcacatcctccatcatgcctggcttcttggcagcgttatttgggagagcctttgagttcatcataagctatccttagggcccttatcctctgtgttaaggtgattctatttcataaagaatttcattcaattctccagttacaaaaccatttttaaatggggttcatacttttttaaaagttgaattcaattctataatacagaaagttactttcatttttttataaaatgtggagagtaagtctcattggaaaaaatcctctcatttggtttaagacagatgaataataaagagagaaaaagataactggattgttaaaatttgactgcaaggagaagataatttaaactcaagagctgtcagcacagaatagaaggaggatgataaaatgcagatcagagatactctaggcaagtgagagttctgaatgaacatctaataatactgaacaaccagtagacattttgaaaacactgagaggccattctctaatagcatcttccccttttagtctaaaagaggattaaaactagatcggagcctaaaagtgtcataggaattcatgtctgtgtgtgcactgcatgtaggtatatgtgtgtgttgataggcatacatacttgtacacatgcacataaaggccaggaaacacctctactgtttgcttcaatgagggacactgctctttctgtctgtttctgtctccttctcatattctctattttggacagggtctctcattgtccctagaactcgccaagcaggataggctgattggctagtgactcacaagggatttgtctcatcctcaccactggtatttcatgtgtgcaccaccacaactagcttcttgcactatttgtgggacttagatttaagtttcatgttcaaggcaacaacaacaacaaaaacagtgaaaaacatctatctttagtcaggggtataaaaatgcaaatgtgtttcctttcagagactttccagaatagagggttagatatggaaccatggggtatcctgctcaccaagaactacccaaacaagccagggaaccaggcagatgtgggtgaagtgggcctgggtacagataactcttccggtagcacacttggtcatcatttctgcaatagtttagataggaactaaattcctgagttctactcagtacttagctgtgggtgtctgcttctgcttccattagctactagatgacggctctagaatggcatataaggtagtcatcaatctcattataggggaagggcatttaaggtagcctctccactattgctcagattcttagttaggatcatccttgtagctctctggacatttccctagtgccagatttctctttagacctataatggtattctctatcaaggtatctcttttcttgctctcctctattctcgccccaccctgactcaattttcctgctccctcatttcctttacttccctcttctccccttttctttctcctaactccctctctccatccccactccccatgctccaattggctcaggagctctggtgtggattggattgtaggctggtaatcctttgctctatgtctaatatccatatattagccagtacatatgatgtttgtcttttttgtggctgggttacctcactcaggatggtttcttctagttctatccatttgcctgcaaatttcaagattccattgttttgttttgtttttggttttgtgtttttttccctctgaatagtactccattgtgtaaatttaccaggctgggtaaacccacagaaagagctgacctgaacaagagggagctcatggtccccagactgacagctgtgaaaccagcataggacagaaccagccatcctgaagatggatgtcacttaggagacctggacagtctatgggacctctagtagtggatcagtatttatccctagtgtatgaatggactttgggagcccattccccatagagggatactctctcagcctagacacatgggggagggcctaagctctgccccaaatgatgtgatagattttatgattcccccaatggaaggcctcatccttcattgggagcagaaaggggatgggatgggggatgggttggggggcatgggaggatgagaggaaaagggaactggcattgatatgcaaaataagactgtttctaatccaatttaaaaaatattaaatttgcaaaatatagtagtatgcagacaatagaatgtcatggaatcttctactaagacttcatacataggaaaactgaagaggccaggtagtgttgctggttaggaggtctgcatacagaccccaacagaggatacatcaggaattgtgaaatggataaagttgcagtggagacctgaggaagttaaagttccaggaataaagattgtctgctgcaagaagctgatggctatatgcatcccagaccagcagggtatccacatggcaatgcccagaaaatctctaaggacagggcttcctacgaagtcctgctacagggagccctggatactgcataagcatcttgcatttttctttctggttctagttttgctttgagtcattttatattctgttattccttcactttggaatgaaaatgttcactccgtgtctgtacaacttgttttgctgctgtttgactcacaaaggctcccaagtgcattttcctttctcagaggaaattttacatttggacattagggcaattgctgggacggttatgacagtggagaccatttggagatggttcggctcactttattttatttttttatttttgagatggatatacacagaatttaatgtctagatcttgtttcctttaaaaacacaggttggggaagcttggtatctaacaaggcactttttggaaggtgggaggcactttgagataggacccaaaaagtggttttcaggttactgaaacaaagggacagtctctctcttttttttttttttgccttattgaaacatgttgatatttaaaaatatcaaaatagatttatgttttgtaaagattagtgatttattgtaatataaaattaattccttgggcttctgaagtctacttgctaatacacagctaaacattttgcattaatgttctgagaaaacctatatagctttcccaactatcttaccagtatgggagtcattattacactgaacttattaaaatctggtgaacatttctgttttttgacgtattttgaaatatttcaagtacactgagaaatatgaactcttttaaaattagataaaccccatctcagcacattagttttagttgctttatctaccagaatatctttaataaccttcaaaaattatcatggcttttacattttgaaatgtcaatttgtcaacttatattttcctagataatttcattttgctccatgtttcacatttgtttccaatagaaaagtaaaaagaaattttacattagtttttttatcaagacttcacttttatttaaaactttgttctcatacttaaaatttattccaacattggcttttgtctctccatgcctaagtatgtgagtgaccccaaatattccccaacatgagcaagcatatattgggaaatattaaccaaaatgcatatgctgcaactatggttagaaacagatatacacacattattcaaaattttcatttaatataaaatactaccaatgtgcatatttggctcctgtgataataagtattagatcatctatgtacatttttctgagtctaaattttgaaacaatacagaagagggaaaatatatagaactaattgtaatggtatgctcacatgcccctttccacatctcaaaaaaaaaaaaatcccagggcttttcagaaaatagatttttacatttatttatgtgtgtgtgatatctatatccatatatctatatatctatatatctatatctatctatacctatctatctatatctgtatctatatctatctatctatctatctatctatatatatatatatatatatatatagagagagagagagagagagagagcaggatttgtgtgagggaggcaagtgcaagtgcacagaagtcagaggacaacatctggaactcaattctttccttccatcatgagggtcccagtgctcaaacttgggtttgtaagtttggtggcaaaggtctttgctcactgtatcatctcaccggcttccctagagttgaatgaagctttcagcacagttatagtattaggagacagggcctttggatgcctacataattatgtcttgagtatataatttctcctaaaaaaataaatgtccttaaaatatagagctactcttcccataactacacttgacagtgaaaacttaccatgaatcacgaccaagaaagagttctctgatcaaagagcaactttgttagtgacttgatgctgcctttccatgaaacaaagccatgagagatagacttttacttcttaccatctgcctaatctgtagaacggcaatcagatttcttcagtcttactatctttgaaatgtagaataattttttgcttcatttttctaacgtgttcaagaaggagactattgctctacaatcatgtacatggttttcaaacagaatgagttacattttattacaacttacatatgttttcttcaagtatgtgtggaatgggatggtatttgattttactgtctatgaggagcacatttattatgtgcttgaaattttagagatggataatattctaagttaacaacaaaactgctctctaaaagatatcgtttcatagatgtatctgttgggactgggttccacaactctgcattttgatttgttgtgggttttttttggggggggcacaatgattgtttatccgataccaaagtgtcagccttgaaaatacacatacaagaaatgttatatagatggagaggcttatatgtaggactatatatgtatttacatatacatattttcatgtagcaataattaacaaaaagaggtcatggatttcaaagagagtaaagaggagtatatggaggaaatggagaaaggaaagggaaaggggaaattatgtaatcatgttatagttatgaaaaataattttaaaaagatactgttatatatacacacagaattgatttaaaagtttgtgttaaaaaggatttagtaagacagtactagttgataaagtccacagtttgcatagaaagtcctttagctacatccttttaaggttctgtagtgctcctgttttcatttatctttcatgtagataaaagacaccatttctctcctgcatcctgtgactactctggtgagtctttgaagactaatacttaagcctcttagtgtcttcatgtgtgaacattcaaatttaggggaattaaaactttgggagatggatgattaaaaatggggaaaatcagatgaaagagaaatatctttccctttgcctctcatatgagagatgtgtatatctgaaggtactttccttctttgctaataatcttccaggttgcttcatgacttaattgcttcttgcatatgacaatttttttgtgtagaattttctgattttctccccctgcagccttgtatacatacttggcctccttttattacaatcactttgagagatattttctacccaagaatcatgggaaaccaactctcaaggaacattattctagaaagcactttataaggaagtagtctcctaaaggtctataaagcagagaagcatatagcattctaactcaaattcatcctgaagtgctttcaaagttcaaggtaagggctcttcaagctgctgaacttttctaatgtgaaactgagtttgttgacaatacaataaattatgtattctaccattaacatgttaaatcttacccattacctggttctgataaattggaacttctattttcttccttattatccaacactcaatgtcacacgaagccttccagagtttctcataagttcttgtctcctctctcaaatttctagagggctttcagccactaagttaaaccctaggtggtgcttcccttaggacataatcaggctggtgaaactattgtacatcactgctttacgcagtttcttggagagtgacaacatgactacacaccacaaagtccttacctagaggtggccatcactcataaccctacaaacattgaacaaatgtgtatttaatacaaatctgggttttaaagctaaaattattcaaagttaaactattaattctagcatttgtaaacagtttggaccctaaagtaaatttatgtatccatttatcatcactgtcactaccatctctgaatatacaagtattgctgtatattcatgaggagtcattaccataggcacaggcaaagttagagctgtattcagacatgccctcaaggagcccatagtctcaagaagaagtttactgcctataaaattacctttgtcaattgcctggaaacttgaggtacttggatttctaaaacctccatttcacttagacatgaaaggcagttagaaaaagaaaagaagatatttgagaaaatttggatgtttagaaattgtagcctataaaagagaagccatttaaaattgtcatttggatatagtagattttgatagaattctcattgttttctcaagttcttccaaactactcccttttggaaaatgctatgtataaaacattagctcagtttaagcatggctttttcctccaggcacagcaagatcatctcatcatcatctaagactagaaattgctttggcctggtagtcaggcaactaactgagtagaatactcatgatagctaggtccgtggtgatagtaacaagcaatttacattccatagcagaaggaaggatgaagaataggtggtcacaaaaccctcatgagatttcagctattccttccttctgatctccatcctccagatgcaaatgatcttgatgctggagtgtataggaagtggaaggataattgaaagtgggctccttgatgcagtattcatagttctgccatcatctataatgcagtggagacttaacagttgtatagatgttttgtggtcatgtaggttcccataaaaaactcatcatccaaactctggaagcaagtccagtgaactcagcttcatcttattggactgtgttgaaatcatgacttttgtctgctgtgggtgctctgtctagatgaatagacttttgttcacattgcttcaggaaaagttaatgtaacaggctcacagataatttgttgtactttgttcatacccaagaatctatttgcttgtttatcaaacatttaacacatttcttccaatgaccacaaattatggagtaattggtagaatttaatttagataaggatagggaaatatttaactatctgtgtctgaaatgaattaaatgtgtcactgaggaaggcaggtagaaccagtgacaaagtccttaaaaatagttctaggaagactaactttgtgaatgaagaagggtggctaaaatggtatctatttgcatactctaaaatgcatatatggtttttatatgtgtatatccatatacaatttgcatttgccagtccatatgtatgtgatctttgtagcctattgatgtgactatggaccttattgatttgactatgctgtctggccagtgagcttcagggatcctcttgttgctgccggttcagtgtcaagactacaaagtacatgccaccatggccagctgtggagcaaactcagaaccttgtgttggatggcacgtattttactaactgagccatttcccagatcccacaacagtgtactcaattaaattgtgtataataattggaaataaaaatgtggagaatggggagtgtaagagggagagtttatattccatcatcacagatgcagtgtagaccctgtagagattaggaacaagggactgagggaagctccatctgaagacatttcttgagcatttgtcatggagtagtgacctgaaaatgaggtttgagtgaagagtgacactcatcacgctcattaatagtctcttctaagtggtgccaaaatgagtcaaagcaagaagagcaaccacagagaacaaacctcaggggcactgaatataggcatggagcagaaaagagggaaaaatataaaacccagggagagagaatcaagaaagagatagatccaaatgataaaatgaaagttcagcacagaaaaaatgtagacacatccccaatgtaggaaaatctgtgcaagtgattatgcaaatgaagagaaaggggttaaaggttgaggtttcttacaagtaaaaatgcccacaggcattatcacatgccagattggggttcattactagaaagtgattagaatcaatgctacagtgtcaggagtcatccaaatggagaggttggcttatgaaaaacaataacagaattaatgaaagggctttaacctttaagttcaacacatatttaattctgtttgtctgagcaaaacttaaatataggggaagtaatttattgttaaagccatgtaaagtgcaatgattattatgctaataagtctggataagtagaatcccttgctttataaatgtcatagattaaaaatggatactgctaataattagagcaatgatgattttatgattttaaacacagatcactttaccctggtgttaattgtcttttgaaaatttaacagttttattttaatcatgtggtgtcatatataagcatttgggatatcaaaaaattacatgtccaacagcttacagccgtatgctaggtatttaaaagacatgaagttttccacatttttctgaagggatgcctgtttaaaatgctatgagagacatttttataggagcacaatttgctttaacagtcattgctttgggttttagatcttgaaatgaaggctgttcatgcctaagtggctctcatattttgaatcaattatctctggtatttgcaattagcgtgctggtcactttttagctgcactcaagtttgaaatgttcagattaggtagaagaaattaactcatttgtgacctttagcatgaataatgtgctttttcaagatttcagattaaggttgaaagtaattcaattttataagccaactggttgcagaaagttgagttttgcagtgtttgggggaagatgaatattttataacacattaaaaagtcctcctaatttttctatctaaatatttcataaatgatttccctcctcgccctccacccagaatacaactctccaaattcagggcttgaatcatgttttctatcacttttgctttcagttctccagtccatctatgtctgattattaactatccaaacaggtctggctacttcagtcatttcttcctaaacagtcttctcagttctgtttgttctccagatgaaattctattttgatcccatttccagtaagagaatctgactgtctctataaggacatatttaggtttggacagtgactattttagatagcaagttctggttagtaggacaaagaaaagagtgcttggagctgcgatgatggctctgttggtaaaaggcttactgtgtaagtacaaggacctgagttcaatcctccaaaatccatataaataattccatgcttggtgatgagcactgggctcctagtgatggggcggtataggcaagcaaatccttttcatctagctggcacaaattgacaaactcagggccaatggcagattctatctcagaaaagcaaggtactcatttcccaaggaaaacacacacacacacacacacacacacacacacagaaagagagagatagagagagacagagacagagacagagacacagagaggacagagacagagagacagagacagagagactgagagagagagagagagagagagagagagagagatgggtctttgaagcaaggccattttgaggaaagagcagtgagaacctgggagaatgaacagaaagagctgccctgctctgagccagttccatcatgcctagatatgattcctataagtcctgcaagatggaaacaccttaaatagaagaagctaaaagaattctggagaagctgagttgcagatttaacttgcagagcccagtgttcttaccaataaccttttatttgccatccccattccttgtcctgtttaaaacattttgagtgaatgaaatgactttcagttgtcatatgcagaactgaatacagctgagataggcaaaatgaacctggggcatggattgaagcattctcctctcttttctttctttaatcattgtccatattccaccaatgagtagttagaagtaaagagagaagactgaaaactgctgtgtttgatagaaatatagctggctatgaggcaaaagcaatatgtaggtttgacataactgaataaatagcatgactctaatctctgtttttaaatagatgtaagatagacaagtaagcacacccatttccttttgatgttaaataaaataaaagaaatttagcggttcaaaataatacacttgcatcatcctacaggtttttgagtccatgttctggacatagcccttatgctgttgtcagggctgaattctcctatagagtcttggctggaggaaatttattcttaagatcacccaggttgttgtcaatgtttttcttctatttcaaagattcagaatcatcagagccttcttgatgattttcactgaaggctgcctgtagggtgctatgtcaattgtcagagagccatcaacttcttccaagcttgcattcgagtcactcttccaagtaaatagcaagatagaatcttacgaacctcttttcaatttatgatgagacctataacacattctattgtcagtatcaagtcacagtcactggtcccttttatatttaaggggaccagtggggactgagatgatactgggcatcttgaattttaagttcttattggaatgtgttgatgaaatggtgaatcaatttatatcatcaagaggaaaccttggatagtattctatgatactgggatataaactacagcaattgggagactatcagttactttcctgctgtgccaaagcacttgacaaaaaacaacttaaggaagagagaatatttcagttcacagcttgaggaatattgcctgtcatagaggggaaagacatagtggtaggagctatgctggtcacaatgtgtttgtggtcgatcctgtgctcagctcgctttctcctcttagtattttcaagaccacagtcaagaaatggaactatccgcatttgaactgggtatttcctcttcagttaagtgtcttcacaaacatgttcagagacctagcccttaggaaattctaaatccagtcaagatgataattgtaatggatcatcaggggaaaattctttgtgttattttattctttcttgacattatctatatatactaatgaaagtgacagtaatagtagaaacctggttcattatggcaggcaaagtaatactgctgagtacttttagttatgatactttataagtagatcacattttgtaagtagatgtgtttgtaggaaacaaacccaccacaatatactttcagtttctgaacaattgcatttgctgctgcattgacttggttctatttcattaagattcattcccctgccaaaataatcatctatatgttgatattcaatgaagattcaggttttaaagactcatcgtgtgtgtgtgtgtgtgtgtgtgtgtgtgtgtgtgtgtgtgtgtgtgtgtgtgtgtgtgattgtgaatggatgtcatgtgtatacaggtacctagggagtcgagaatgaggctttgggtccctagatgtgggtgttacatcactcaatatgggaactaggaactcaactctgtcctctgacaaagcagtagttctcttagctgttgagccatctctttagacacttattgaaatttatttaggtaacagtttgaaatgttttagattttgaggcaacatttaaaagtagctctgaggtcaagttttctccaaatcaagtacatatgcttcttccttatcacactactatgatgctatgggatgaagtctttgagctaaagaggattaggtaagttgtgtatgagagcaaaataaacactagtggccttaggagctaagtcaggagaaatagctttctagttttctgcaatataagtataaggaagacccaatagtgatggcctggcaatggccctcagaagatacagagtttgtctgcaacttgaatttaaatatctctaactgtgaagtataaatgtttattttatgattcattttgtctatgacaatctgttaaatgaccctacattttcaaagatatctatcaagacattatataacacagagaactgagttggaattaatgttttaaatgacataataaatctatactggtagcttttacattttggtaaagatctcatctaattctaagctgatttcagctattatcagactttcgtgagactgatattaagttaaccatataagggctggtgaaatggctcattggataaaggtgcttggtgccaaataacctgagtttaattttcaggccccacatggtagacagtgagaatagactccttcaagttttcctttgattaccacatgtgcactgtggtgcacttatgtgtgtgtatgtttcacgtggacacacaggcatataaataaataaattttaagataactagagtgaactgagatttgtagaatgtttttggaagagtcatcttttaatagttctgcagcacaaaaccatgtaacatttactaagcctcagttctatgattttgggggaaaactctgaaatttagtaagagtcatgcatatttatctcatctaatatcattgtgtaggctttattggcaacagtatgaaggtaaagcaatcttttttattaaacaataattttcatttattttacatcctggctgcagtttcccctctctcctctcctcctgcctccctactccatgcctcccctctgcctcccccatccacccctcctctgcttctgttccgaaagtcaactttaaagaataagggtaagctactaaagggcacatacttttttttaaatttatttattagttccagttagggaacaagcttgattcacatgtaagtcccttctccctctccctccccacactccatcccttctccctcacccccagcccacccaccactccatccacccactactccccaggcagggtggggccctcaaaggaggctctgcaaagtccaccaaatcttcctgtgatgggcctgggcccttccccatgtgtccagggcctgagtgtaacccttcatgtgggatggactctcaaagttccttcttgcaccagggaaaaatactaatccaccaccagaagctccctggagtgcagaggcctccttattgacatccatgttcaggggtctggatcagtcttgtactggctacccggacagcatatggggtcgatgtgttctcccttgttcatgccaactgttcctgtgggtttctccacctggtacagaccacttcactcttcattcctccctctcttcaactaaattcctgatttcagctcagtgtatatctgtggatgtctgtctctggttccatcagccactggatgagggctctaggatnnnnnnnnnnnnnnnnnnnnnnnnnnnnnnnnnnnnnnnnnnnnnnnnnnnnnnnnnnnnnnnnttatcctctccaccattgcctggattgtcagatcgtgtcatccttgtaggtctctggagatctccctagttccagatctatagtggttccctctgatatggtatgtctcatcctgctctctctcctctatccttcccccaactcaatatttctgcatggttgaacatatgtccttgtatgaacatgcactgttttgttatatacccaagagaggaatggctggatcttgaggtagactgattcccagtctcctgtgcctatttgttcaagggttattcccactttctcttctagaagattcagtgtggctggatttatgctgagatctttgatccatttgcacttaagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatagatttagcacctttgtcaaatataaggtattcgtaggtgcgtgggtcaatatcagggttttgaatttgattccattggtctatctgtctatttttgtgccaataccaagctgttttcagaactatggctctatagtagagcttgaagtcagggatggtgatgccttcagaagatcctttatcgtaaatagttgttttgtctatcctgggttttttatttttctatataaagttgagtatttttctttcaatgtctgtgaaaaactgtgttgggattttgatgcggattgcattgaatctgtagttgggagagaaaaggaaaaggaaatagaaagtcctttaaaaagaaatagagtagctagttcttgtggtagacacttttaatcccagcactcagaaggcagaggagccagacatatctctgtgatttctttttttttattagttcaaattaggaacaagcttgtttcacatgtcaatccattctccctcttccacccctcacccagacccctcctaccctaccccgacctaccccccactccatccaccctccactctccaggcagggtagggccctccacaggggctccacaaagtccaccacttttgagttaattttgtatcctgctaccttgctgaaggtgtttgtcagccatatgagttccctggtagagttttctgggtcactaatgtagactattatgtcatctgcaaatagtgaaagtttgacttcatcctttccaatttgtatctaaagggcacatacttaagacaacctgactccaaagctcacatgcaaatagctgtacaagatgttttggatgaacagaaatacgcttgtcttggactggttctactttgcatgaatagcatacaaattaaaatgaataggatggcatttttcatctagaagacagatatgtctccttaacaacttggtgtgtttgatactgagactaaccataatatgtgttcctgacctggaggtccatttctacaaaattattattttcctttcaaagagttatattggtggtgtccccatgctgatgtgtgtactacgtctgctgtcatgtccattttttccaatttcctggtgtagcttttgtaaaaaatatgtttcgtatatcttatttgacatttgttttaagacaggtagaagatgcagtctctgtgtgatttcttcatctctgatttattctaggagtatatatgagtatctcaaatacccactgtttataaagacagctgtgtgatttgtaatggacctaggcttccaataacatatgtccttaggatcctaagtgacacacagatccaccaaggctgggtctcctaccttattagtagcctagtatgtagaacagactaaaagtcagtcctttgtggcaagcaaggtgataccaatagttatggcacagacagaggcaatctttcgaatgtagtagtgtaaatgacctcccctagggctcttaggatgaatgtgaaggtttctgagactttataaccaggagtcactattctattcagagacacaggatgggatagtgcttttttaagcctcatatgatcacgtcatcagatgctggatcctggccccaaaacctatggattcaaatttccttagtacaattggacttttcctgacttctgtgaggtaatcataccaagtacggggcttgtaggatgttaattattttgttgcaggactcagataatctttgttccaagacccaagatataagaaaaaatggtaccaagcatctggacatagctgttgtggtaccaagttcatgaactgtggaggagctcttctctagagatctcaagtcatgcacagatatcatgggagttgtgatgtacactagtatccacgatcccatctgtgttgtacctgaatctagattttctctaggtcatgcccttgaaaggctaatggtgatggggctcatgggtcattcttattcctgtttccagtggacaagcacaggtgagtgaagagttttgtaccagtagctacagtttcaggtctgtaactggggagacaatctttctggctcaccctggaacagttgtgattgtgtcttttagtcactggtctgaggacatgataccttttgtatttggtgtagcatatatcagtccaaagatctctactgcataagagaggctgctgtttgctctaagtaaggtctttgctaagtagaagagctgtgtggttctgagagctggaggaagctcaaaggggatattccttcactggagcagagtactcttgactagctagttctcaaagctggagttcagtccctggaggaccctgaaattttcctatagtatggttgcttgtctgttgctaaagttgggtttctggcactttccaccctatctttcctctttttcagcagtgtgaggttcccacaaacactgccatggagatgggtttgaagttacagtttctctggtttgttgtctatgttgcctccttgactctgcattgctctgtgtttctgtaacttcttcacttacttctagacttccccttcagccacttgtttcaaggcacagctttgctcttgccctggttcttctttgtagcagttgggtggaaggcacttctactagtcatgttggtgtctatctcaaccaagcttaggtattaaaagaactcagaaaaagtgagaatttcttggttgctcccatatgactgcacatactggaatgcatatgctcattttggcaaagagggatatgaaaccaagcagatgggaaaaatgtaattagtatttaatgttgaacagactattttctcctgatttttgagcattttcctttatagtcaaaatttgacttagatatagtttagtgctattgaatgacataaacacactactgaataaataaagtagacaatattatgagccaggttccttgcttttttgatgaactcttaagattaaccacctacagattaagtagaactaatatttccagaaacaaattaaatatttctaacactaaagttggaaaggaaaatcctccaaagagagctttcactacaatttaggaaaaacatcattttgggtgagtttttcacttgaaaattcatttagtgacctctcagggatgttgggtaaatgcactactgttttgtaaatagctttcagtatgaaatgtgataggtattttagaattgtccaaaaaccaatcttgaaacttcaagtaaagttaaaaaaaatgtctctagtatttgtgggtgtcctccaaacaatggtaaactgacagcttctagtaaagcattccagaagaaagcatccatgcaaattaggaaatttccccatagtagaatagagacatttaaggacaaaagtggtagggaatgtgtaagaatactcagtgatctttactgaatcctaaccctcagagtttggtattttctgtttattttcagatccttttaaaatcacttcttgttgttttctcagtaagtctaaggtctaagaattaggccacggggttactgaaacaaaaacaaatggtctttaaaactttaaatgcagaaggaatgtgttttaatagactgagtagtctaatttaaaaggatagaaaagtaattcttttcaaatacagttattccctttttaaatataatggtgtttcttatatgtgtttatgaggtatgtaaagctcatggtcatagatgctttttcacatgttctcaagcctccctcccccatgatgctgctgtataattggtggcatgggtttatcattactttggtcttaactcaaagttgttttaatttatgcatatatataatccttcttgtcttaatatgagaggaaaaaagcttctaaggacaggctttataattttcctttggtgttcaaaatgtagcaattattggaacaaacagaaagatgaacaatatcagttgattaactaagtttcccttttaagtcatgaaacccactcccatggaggaacatctgaatgaaagaaagcaaattcttcctcattacataattagaccacaagagagtcacactttctttcaagtatcatatagattctggggtgtatgggccactgtgagaaattcatcttgagctcataaaaacaggaatttaattttattgattatgactttaaactgtacttttaacatttggattggtaattaggaaatattctgatcacattggtagctatttggtgttatcaaggaatgttacatttgttaaaccagcaatttgacatttctagatttttctctttaatacttggtgctaaaattgaaagaatatgtgcatgtatgacagtgagcatgtgtttatgtgtgtgtgtgtgtatatttgtgtgtaattttaatatagaggacaattttgtttcctatatggaaacatcatttatcttttatttgacttcagagttgtacacatgtctactgttcttattttcatagttaaatatttgatgcaaaaagaagtgttcaaagaaaaacagttgtcaacnnnnnnnnnnnnnnnnnnnnnnnnnnnnnnnnnnnnnnnnnnnnnnnnnggctacaccaacagccccctcactctgcccctaaacagacacatcccccatgacttcagcagcttcctaatacacagacatctattgcacagagaggactgagacagaggactgagaggatcagatcaagaagcaaagaagagatgagtagatatcaatgcaataatacattcagcaacctaaaaagcaataagacaatacctgaacctagtggtactacatcaagaatatctgtataccccaatgcagaggaagcagaagaaaatgatcttaaaaataactttatcaagacaagatgatggactcccaatgagatgatgagaaagactaagtagacttcctaggggatgccttaccctctcctaggagcagatgggaagtcaaggggtggggagggagggagcaagaggagaagaagaagggggaactggaattggcatgtaaaaaataaaattaataaaaacttcatcccccacagaaaggtgatggaggcccttaggaagaaatgaagaatttccttaaagaaatggaacaaaaaattggaagaaatcaataaatctcttaaagaaagccaagaaaaaaaacaaaaacaaacaaacaacaaaaaacccaatcaaacaagtccaagacttgaaacctgaaatagaggcaaaacaaacaaacaaacaaacaaacctaggaattctggaaatggaaaatctgggcaaatgaacaggaattacagatgcaagcataaacaacagaatgcaagagatgaaagagagaaactcatgtgttgaagataggatagaggtaatagattcatcactcaaagaaaacattacagccaacaaagtcataacacaaattgtccaggaaacctgggacaccatggaaagaccaaacctaagaatgatagggatacaggaaggagaagaaacccagttcagagacatagaaaataaattcaacaaagtaatagaagaaaacttttccaacctaaagaaggaaaagcttacaaagataaaagaagtttacagaacaccaaatagactggaccaataaataaagtcctctcaacatataattatcaaaccacaaaatatacagagtgaagaaataatattaaaagcagcaaaggcaaaaggtcaagtaactataatggcagagcatcagaataacacctgacttttcaagggagactctcaaagccagaagatcctagaaagacattatgcagattctaagagactgtgaaagccaacccagaccactatcaatcaccataggtggagaaaacaagatattccaagagaaaaccagatttaaacatctatccacaaatccagtccaacagaaagcactagaaagaaaattccaacacaaggagttcagatgtacccaggaaagcacaggcacaggcaatagatactcccacactagaaaaacaaaaaacaaaaaacaaaaacaaaaacaaaaaaaacagaaatcaataatcactggccattgttatcccttaacatcaatggactctactcacctgtaaaataacaaaggctaagagaatggataggaaaacagaatctatcctgctgcatagaagaagcacacctcaacttcaaatacagtcatttcctcagagtaaaaggctggtgaatgacttttcaagcaaatgaacctaagaagaaagccagtgtagctatcctaatagctaacaaaatagacttcaaactaaaggtaatcaaaagagatgatgaaggacatttcatattaatcgctggaaaacctatcaagaattctcaatcctgaacatacatgcccaaaatacaagggcacacacattcgtaaaagaacattactaaagcttaaatcacacatcaaaccacacacactatattaggaaacttcaacaccccactgtcacaggtctgccggacagaataataacaaaaataaggaatctacagatgttacaactcaaatgggcttaacagacacatattgaatattccactaaaacacaaaagaacacaccttcttagcacccaatggaaccttctctaaaattgaccacatacctgataacaaagcaaatatacatagatacaaaaaattgaaataaccccctgtgccttactggatgaccatggcttaaagttagaattcaacaacaacgcaaattctagaaagcctgcaaactcatgggaactgaataacgcccaactgaatcaccactgggtcatggaataaataagaaagaaattaaacatttcctagaattcaatgaaaattaatgtataaaataaccagacttatgagatacaatgaaagcaatgctaagaagaaagttcatagcattaagtgccttcataaagaagttggagaaataccacactagcaaattgacaaaacacattgaaagctatagagcaaaaagcagcaaattcacctaggagaaatagataacaggaaataataagaatgagggctgaaataaataaaatggaaacaaagagaacaacagaaaaacagtatacatgacaaaacaaagagttggttctttgagaaaattgacaagatatacaaatccttatccaaagaaaccaaaggcagagagagaatatccaaactaacaaaatcggaaatgaaaagggagacataacaagagacactgaggaaatacagagaatcaacagatcatatgtcaaaaacctatactacacacaatttggaaaatttaaaagaaatggtcagctttttcaataagttctccataccataagtaaatcaagagcaaataagtaatttaaattgacctatagacactgtggaaatagaaacagttccccaaagcctcccaaccaaaataaacaaataaataaaataaagcctaggagcagatggcttcagggcagaattgtatcagaatttcaaagaaaagctaactccaatattcctcaaattgatccacacaatagaaacagaaggagcattgtcaaactccttttatgagactacagtaatcctgacacccaaaccacataaagataaaacaaagaaagagaactacagaccaatttcccttatgaacactgacgcaaaaataatcaatacaattttggcaaactgaatcccagaacacataaaaaaatccaccatgaccaaggggcttcatcctagagatgcaggtttggtttaacatactgaatactgtcaatgtaatccaccatataaacaaactgaaaaaaaaatacatgatcatctcattagatgccaaaaaagcttttgacaaaatccaacacatgttcatgataaaggtattggagagatcatgaatataaggaacatatctaaacataaggaaagcaacatgcagcaagccaacaccaagttaaacagagaaaaactcaaagatgttccattataatcagaaacaagacaaggctgtccactctcttcctatctattcaatgtagcacttgaagttctagctagaacaataagacaacaaaagaccaacaatgggatagaaattagaatggaagaagtcaaactatcactattggcagatgatatgatagtatacataagtgaccccaaaaactctacttgggaactcctgcagttaataaacagcttcagtaatgtggcaggatacatgactaactcaaaaagaatcagttgccttcctatatacaaatgacaaatggattgacaaatcagagagggatcaccctttacaatagacacaaatacaaaatatcttggggtaactctaactaaaaacatgaaagactcatatgacaagaacttttttaagtctctaaataataataataataataataataataataataataataataatgtatttaatatgaagcaatgaatttgaccacaaaattgaagaggatatcagaaaatggaaaggtctcccatggtcttggatatggaggatcaacatggaaaaaatggcaattttaccaaatgcattctaaagattcagttcaaaccccatcaaaatgccaacacaattcataacagacattgaaagaacaatactcaacttcatacagaaaaataaaaacccagaatagctataacaatcctgtacaataaaacaacttccagatgttcacaatccctcacttcaaactctactatataactatagtgataaaaaaacagcttgaaattggcacagaaacagacaagtagatcagtggaatagaattggcgttcctcacagtaatccacacaccaatgcaacctgatttttgataaagaagccaaaatggcacaatggaaaaaggaaaagttctttaacaaatggtgctggcataactggatgccagcatatacaagattgcaaatagattcatgtctattgccaagcataaaactcaaatccaagtggatcacagacctcaacataaatccagctacaatgaacctgatacaagagaaagtagaaagtagccttgaaggcaatggcacaggagaacagttcttaaatataacaccagtttcacagacactgaaagcaataatcaataattgagatctcctgaaattgaaaagcttctgtaacgcaaagacattgtcaataatacaaaatgacagcctaccaatgggaaaaggtcttcaataattccacatctggcaaagggatgacctctaaaatatataaagaactcaaaaaactagacataaaaatacaaaataatcctattgaaaaatggggtatagagctaaacagaagtctcaccagaaggatctcaatggccaaatgacatataaggaagtgctcgacatccttaatcatcagagaaatgtaaatgaaaattactccgtaatactatcttgcacctgtcagaatggctaagattaaaaaacaacaacaacaacaacaaacaacaacaacaataaaaaaataccaaagacagtttatgctggagacaatgtggagaaaggggaacactcctctattgctggtgagagtgcaaatttgtacagccattttggaatcagtatggtggtttctaagaaaattaggaatcaatctacctcgagacccaggaatacaactcttctcctcttgggcatataccaaaaggacacacaattatacttaaaggacacttgctcaacaatgttcatagcagcattatttgtaatagccaaaacctggaaacaacctagatgtccctcaaccgaagaatggataaggaaaatgtggtatgtttacacatggagtactactcagttgtagaaaatgatgacctcacataatttgcaggcaaatggatggaactaggagaagccatcctgagtgaggtaatccaggctcagagagataaacacagtacgtattcacttataagtagatattagatgtaaagccaaggataactagactacattccacagtttccagagatgctaagtaacagggagaaccttaactgggacacatgtgtcaccctgggaaattaaattcaatgagatctatagtgtaaactgtgagcaggagtgaggtgggggttgagaacagaggaaaaagttggtctacatggagcaggatgcagtggaagaacaatgaacaagatatcttaatagagagaaccactatgggcttctggagaaaattagtgccagggaaacttccaagaatccacaaggatgacgccaactaagactcctatcaataagggagaggatatccgaactggcctacctctgtaatcaaacggtgtgtactccaagtatcatcatagagccctcatctaggacccagatccacaaccaagaaccaggctgcgctccagaaatccagctgaagagagggaggagggaatatatgagcaaggaaagttaagatcatgatggagaaatctacagagaaaattgaaccaagcttatggaaactcatgaactctagactataactgtgtagactccaggggagtgaactaggccctccatatgtctgagacagttgtgaaacacagactagctgaggagcccctggccataggaccaaggcacaaacctggtacatgagatagaaagaaaataattttatctaaaacttgtttttttcatattttctttatcgcagagtctatctagatatgtgtcaagtatgaattttatattttaattgtttgcttaatgtttgaatataaacattttatcttaatgacatcataactattggatcatctagcacatggacattcttgacattgtaattttatactgggcccagtttactttgccattaataaaaactattcaggcaacatttcttatacttccttattttttacttcttaagagaagcttaggtaagtttttacttcttatatgcttcgtttaaattttctggacaagtacgccaataaatgcacagattggatatgtgatctaggtgtagcaaagcctgagatagtatctttaaaaaatgagtgcttttattctcaagcatctctttatttctgcagtaaagtatcaaattgtgatcaaacatataaactacatttgatcatcatgcttactattgcttagaattaaaggaaataaaaggaccagaaaacaaatttaaaaaatcctacagtttagctattgtagctctcagagatccaaaatggctggtaatgaataaataaagaaaccaatggaattaaaggagagaagctgttattccccccccacccctccacaagatagggtttctctgtgacttcggtggttgtcctggaactttctctgtagaccaggctggactcaaactcacaaagatccacctgcttctgcctcctcctgagtgctgggataaaaggtatgcaccaccaaagcccagtaaagctgttgttcttatataaaatgatgtaatgcctgctgtatgactacttttcctgtgctctttaaaatttataactcttcccttttatggtcccacttgctcacaaggatggccactctcctggatgtcaatgtttaccacagctttgtgaatatagcctcaatctttaccatccccttttgggagcaagccttctatctgaactctcaatcacaaactcttgggttgctcttgggttccattcttgtatttaattatcaccttcaaatggagactaccagtgaccacacctctctcctaaacatgccatcatcattttactcatttccttgagcatactttcagtcttacagttttgctgccattggtgttaggtctcaccacttgctgatataacctctgttaagttaattaaattatcatgatgtcttttagttgaactgttaagtaacaatctcaaaaacctttctattaggctacctgtgagttcacattcactaacagagtagaacagtgctcaaaatatgatgttccctattcagaaataattccctattgtatgaaactgaatttgacataggaaggatgcacacatgatttcataaaatccaaatgaatataagagtgcaaatgaatctgatgcattcagtaagtctaatctagcattgagaacagatccctgatcgttttattgggtggcataacagggatgtgctacttccttgctttgctaggccagtaataacaaatgcctaattagaggcaggaagaggaggctatgggttttacctgaaagtctctctgcatcaagtttcaatgtagcatattctacatctgttctttcttcattgtcagttctagcctaattcagaacctgttctttaccatgtggatctttaaatagtttctaggctactttcttcttagggatgggatgtctcctctgcagaatggctcctcattgtcttgactatctttttaaagtatagccattactagaccatcaactatacagtgaggatttgataattttctatgaatatgaaaatatgaatccttttgaccacatgtatttcatacatgtgaagtttgagattagctcactttcatggaaattctattatatctataatgattatgaaattttacatgatggtctacaagttcagtgaaaaattattagtctaagctaacattcgttgcataggagactaatttgactagaccaagatattttcatataaattgcattttactaatttaatttgttaaatttacattgatatcataactagagttttactttattaaatctctcattcacagaaaataatcaataactgaaaagtcacttactagagcacaaagatggtaaaatgtttggttacagtagcacaaaacagggttagatataaacagtgattaggatttgtgtaagtaatgaatgtggggttggagacatgtctcagcagcaaaggcttcatattgctcctacagagaatctgagttcattttcctatatcaacacaggtcagcttacaactgcctgtaacttcaactgcagagactacagaggatccagcactcacatacatgcacaaaacacatggacacacaaacacacatacacacacacacacactcacacacacacacacacacacacacacacacacacacacacacacacacatccattgagacacaattaaaaataagttagtctttcaaaagaaagaatgggaattttttccttgggaaattgtttattaatttgttaaatgtatatgtatacatgcctgctaggcattctggaggccagatgagggcatctagtctcttgggactggagttacagacagttgtaagccatcctacctgggtgttaggaaccaaacctagatcctatgaagagtaccaagtgttcttctaaaatatattttcataacctctgaaaatgttttttcttagaatataaaataattttttattttttatttatttgaattacaaacaagattgaattacatgacaatcccagttcccttctcccccccttcctcccctaccaccccccccaactaaaatcctacctatcctcttcctctcatggctcagccgttaaaggctaggctcacaaccaaaaatataacaatatgaaataatttaataaaggcagcaacaaaataaaatagcagatagaaatcaaaaagattatctcaaattagatttgctgaaatgagcctgtaaatttcaattcctacacagttgtgaattcttgacatgtatgtaccaggctttcttttcagctaccaaccagctcctaaatcatgacacagagacgtcttattagttatgaatgcttgacattatcttacacttattgatagtttcttgctagcttgtatacgttaacttattttttcttcacctatatattgcattggggatttttaccttttttcttcctgtgtatcttactttcttgctgtatccatgagtggctcatatatgcctggtttctgatgtgggcatgcccttctttctctcttgttctcttctttcttcacctctctcctctcttgccccccctcctacttattctgtctgtccaccagcactacaacacatctttacatagttaaaataatattccatgctctgcccttcacctgctgcctgaagtgagtctgggcaatgctaagcccccaacttcccacatcaccccctcctcccttcttcctgagcctgccccttgacaaggttgacctgccatgacaggagggcccaccctgaatctggacaacctccacccttgtccatcctccagcctctgcctctgcctgcagcctcatgtgagtctgggcactgctctgtccccataacaccatcctcacttcttcctgagcctgtccctccaatagccccaacagactggaaggctcaccctgagtcaggacacacctcattcttggttcccattctgccatcttccctttgcttgaggagagtagaagagagggagagaccccaactgcacccactggaagaagggatgggaagaagacagaataagaacacattcaacaacagaaagaccaatatgacaccaccaaaatctagggactccacaccagtaagaactgaaaagcatggttccagttagtcgttgctgctcagagtcacctgacacaagcaacctgtgtgccggatcgagttcagtggtggatccaacataccgaggcccagtgacagttctgtctccaactgctggtccagcaggacctggcatgcccaaacactgccgacacccgggaaacagtgacacctctatccactagtagagaaccgacatcagagtattggatctgtttgcatctaccagaagagaaccttggtctcacacccacaaggagaacaagaaactcttgctacacccaccagaagaaagcatgagaagaggacaaggtaaaagcacatccaacaacagaaaaacaaatatgacaccaccagagactaggaacaatacaccactaagacctgaacatcacaaagcagatgaaccagaagagaatggccttaaaaacatcttcaggaaaatgatagaggacctcaaagaggaactcagaggacatgagaaaatcccttaaagaaatggaagaaaaaagtaaccaaaaaatacaagatatcaacaaatctctcaaggaaaaagttcaagacctaaaaattgaaatagagacaatgaagaaagcacaatctgagggaatgctggaaatagaagagctgggtaaatgatcaggaaatacaatgtaagcataaccaagagaatacaagacatggaagagagaatctcagggtttgaagacacactagcagaaatagattcatcaaacaaagaaaatcttaagtccaacaaatccctatcacaaaatatccaggaaatatcggatatcgtgaaaagaccaaacctaagaataataggtatagaagaaggtgaagaaattccactcaaagacacagaaaacatattcaacaaaatcatagaagaaaactttcccaactgaaggaaagacataccaatgataatataggggtgtggtggggagatggggtgggaggtaggttgggggtgggggaggagggatgggtgtgaggggagggagagggagaagggacttacatgtgaaacaagcttgttccctaacttgaactaataaaaaatgtaaaaaaaaaaaaagaagcctacagaacaccaaatagattgaacaaaaaaaaaaggtcacctagccacataataatcaaaacaccaaacatacagaataaagagaaaatattaaaagcagcaaaggaaaactgtcaagtaacctaaaaggcaaatctatcagaatcacacctgacttttccttggaaactctgaaagccagaaggtcctggatagatattctacctacattaataggccagggatgccagcccagactactatacccagcaaagcattcaatcattatagatggagaaaacaagatattccatgacaaaaccagattcaaacaatacatatccaccaatccagccctacagaaattactggaaggaaaactgcaacccagggaagttaactacaaccagaaaaacataggcaatagataatcccaatttaccaacagccaaaaggaaaaagggtcagaatcccacacataatctcaccactatcaccaaatcacaaacaaacaagaatgaacaataatcaatggtcattaatatccatcaacattaatggtcttaactcccctataaaaagacgcagattagtagaatggataagaggacagaatccttccttctggagcatacaagaaactcacctcaacctcaaagacagacggtacctaagaattaaaggttggggaaagatcttccaatcaaatggatccaagaaacaagcgggagtagcaatcctaatatccaataaattggacttcaaacaatatcagtcaaaagagatgaagaaggtcatttcctactcatcataggagaaatccatcagggtgaagtctcaattctgaacatttatgccccaaatacaaaggcatccatgtttgtaaaagaaacattagtaaaactcaaatcacacataaaactgcacacacttatattggaagatttcaacaccctactctcaccactggacaggaacaccaaacagaaacttaacaaagaaacaaaagatctaatagaatttacggtgcaattggacttaacagagcaagtgcttaccaacttgctccacccaaatacaaaacaatttaccccagcaccacatggaaccttctctaaaatcgaatatctaaaatctaatatctaaaatctaatatctaaaatatttggcaacatagcaaacgtcaacaagtacaaaaaaaattaaaataacccgctgtgccttatcagaccaccatgctttaattttagaattcaacaagaacacgaactacagaaaacctacaaactcatggaaattaaataacacccaattgcacaattcatgggtcnnnnnnnnnnnnnnnnnnnnnnnnnnnnnnnnnnnnnnnnnnnnnnnnnnnnnnnnnnnnnnnnnnnnnnnnnnnnnnctatgggatactttgaaagcagtgctaagaggaaagttcatagcgctaactgatcacatgaagaaactggataaaagtcacactagagaattaacaatgcaactggaagctgtagaacaaaaagaagcagactcaccctggaggagtagaccccaggaaaaataaaattgagggctgaaatccataaagtagaaacaaagaaaacaatacaaagaatcaatataacatagagttggttcctagagaaaatcaacaagacagaaaaacctttatccaaactaaccacaaggcagagagagaacatgcaaattaacaaaatcagaaatgaaaaggagggcataataactgggactacagaaatccaaagactgttcagctcatactttgaaaattttgctccacaaaatatgaaaatttaaaggaaatggacaattttcgggatagttttctggatagatttcacttaccaaaattaaatcaagaacagataacttaaatagacctatatataacctctaatgaaattgaagcagtcattagaagtctcccaaccaaaaaaagcccaggaccagatggcttcagtgcagaattttaccagaaattcaaagtacagctaataccaattctccacaaagtattccacacaatagaagcagaagggacattaccaaactctttttatgaggcttccaaccttgatatccaagccacacaaagacacaactaagaaagagaactacagaccaatatccctcatgaacattgatgcaaaaattctcagtaaaatattggcaaatccaagaacacatcagagaaatcatccatcccgatgaagtagccttcatcccagggatgcaaggatggttcaacatatgaaaatttatcaatgtaatccaccatataaacagactgagaaaaaaaaaccacttgatcatgtcactatatgctgaaaaagcctttgacaaaatacaacaccacatcatgataaatgtcctggagaaatcagggataacaggaacatacctcaacataataaaagcaatatacagcaagccaacagccaacatcaaattaaatggagagaaactcaatgcaattcctctaaaatgaggaacaagacaaggctgtccactctctccatacctcttcaatattgtccttgaagttctagctagagcaaaaagacaagatgagatcaagagaagacaaatcggaaaggaagaagtcaaactctcactatttgcagatgatatgatagtctacataagtgacccgaaaaactcaaccaggaaactactacagctgatgaacaccttcagcaaagtggcaggatacaagattaactcaaaataatttgtagccctattatatacagatgccacattggtggagaaagaaatcagagaaacatcaccctttataattgccacaaacaacataaaataccttggagtaacactaaccaaaaaagtgaaagacctgtactgtaagaattttgagtctctaaagaaagaaaaagaagatacccaaaaatggaaagatctctcatgctctaggatagacaagatcaacatagtaaaaatggcagtcttaaccaaaagcaatctacagattcaatgcaattcccaacaaaattccaaaacagttcttcactgaccttgaaagaacaattctcaactttatatggagaaacaaaagacccaggatattcaaaacaatcctgtacattagaggaacttctggaggcatcaccatccccaactttaagctctattacagagctatagtcctgaaaagagcttggtattggcacagaaatagacaagtagaccaatggaatagagttgaaaaccctgatattaacccacatatctacaaacaactgatttttgacaaacaatccaaacatatatgctggaacaaagagaacatcttcaacaaatggtgctggcataactggatacaaacatgtagaagactacagatagacccaagcctttccccctgaacaaaacttaagtcaaaatggaccaaaggcctcaacataaacccagccaaactgaacctactagaagataaagtgggaaatacccttgaattaatcagtccaggagactgattcctgaacataacaccagtagcacagacactgagatcaaaaattaataaatgtgacctcctgaaactgagaagcttctgtaaggcaatggacatagtcagcccgacaaaacgacagcccacggactgggaaaagatattcaccaaccccacatctgacagagggctgatctccaaaatatacaaagaactcatgaagctattctcaaaaacaccaaacaatccaattaaaaaatggggtacagaactaaatagacaattctcaatagaggaatctaaaatggctgaaagacacatgagaaagtgttcaacatcgttagccatcagggaaatgtaaatcaagaaaactcggagacaccatcttactcctgtcagaatggctaaaataaaaaataccaatgacagtttatgctggagaggatgtggagaaagaggaacactcctccactgctggtggtagtgccaacttgtacagccactttggaaatcagtatggcgactcctcaagaaaatgggaatgagtctaccacaagatccagcaattccactcctaggcatatacccaaaagaagcacattcatacaacaaggacatttgttcaaccatgttcatagcagcattatttgtaatagccagaaactggaagcagcctagatgcccctcaaccacagaatggatagagaaaatgtggttcatttacacaatgaagtactactcagcagaaaaaaaccaatggaatcttgaaattttcaggaaaatggatggaacttgaagaaactattctgagagaggtacccaatcacaaaaagaaaaacatgatatgtactcactcatatgtagacctgctttatgatacatagtagtgaccatgcttcatcagagctctttttaatgatgttgctcagaatggtttccttccagatgatgattgagaacctaatttaaaaaagtggtgccacgtaccacaagagtaacagaactgtgctgttttctgggattttgttttttacctttattttttaatggagtgtgctggatgtctctacaattttgttcaaatgactgcagaacctggaaaagctgttgctgctattgatgcataacatgttgctattattggtcttttttatataaatatatttaaaatataaataaatagaaatatatataaaagaactgaaagtccaatgcaaaggatgaagatgacatgggccttaaaacttatcttatgaagatgatagagaccattaaagaggaaacaagaaaatcccttacagaaatagaagaaaaaaggagcaaaaaattacatgaaatggaggaaaagacaaaccaaaaattcaagaaataaacaaatctcttaaataatctaaagaaaaccaagaaaaaacaaccaaacaagtgaaggaaataattcaaacagtccacagtttgaaggcagaaacaataaggaaaacacatgaggggatgctggaaacagaaaatctgggtaaacgatcagaaaccactgatgaaagaatcaccaatagaatacaagagatggaatgggaaaataatctcaggtggatatacagtcatcaaccaaagcaaatctcaagtacaaaaaatccttaacacaaaatattcaggaaatatgggacaccgtgaaaaggctgaacctaagaataataggtatagaagaaggtgaagaaatacagcttaaagatacagataacatattcaacaaaatcatagaagaaaacttccacaacctaaagaaggatgtgcctatgaaagtacaagaagttagggataaatggtccccaggaatgggaagtgtcataaactcctcagctaattgggagcatgatggtaggggagagggagctgccacaataagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtctgtaccagtttggagaaacccacaggaacagttggcatgaacaagggagagcacatcgagaaaggaaaaatattaagatcagaaaaagaaaaatgccaagtaacatataaatgcagaactatctgaattacacataacttctcaatggaaacattgaaagctagaaggtcttggatagatgttctaaaatgctaagggaacatggatgccagcccagactattgtatccagcaaagatttcaatcattataaatggagaaaacaagatatttcatgtcaaaaccagatttaagcaatacatatccacaaatccagccctacagaaattattggaaggaaaacttcaacccaatgaagataactattcttaaaaaacaaaaaacaaataaaaacacaaaaaaacataggcaatagataatcctgctttaccaaacaccaaaaggaaaaaagagtgggggaaatccacacataataacaccaaaaccaacaaatccaaaaacaaacaagaatcaacaatcaatggtcattaatatttcccagtgtcaattgtcttaacttgcctataaaaatatacaggctaacagaatggatacaacgacagtatccatccttctgctacatacaagaaacactatctctatgtcaaagacagacattcgctcagagtaaagggttgggaaaagactttccaatcaaatggacccaagaaacatgctggtgtagcaatcccaatatctaataaagtagacttcaaaataaaatcaatcaaaagagttgaagaagggcatttcatactcataacaggaaaaatccatcaagatgaagtctcaatcctgaacatctatcccaaatataaaggcacccacattcataaaagaaacatatctaaagcccagatcatgaataaaacctcatacacttatagtaggagacttcaacaccccactctcaccactagataggaacaacagacagaaacttaacaaagaaacaaaagaactaatagaagttatgacccagttgcatttaacagaacattatatccaaacacaaaagaatataccttcttcttggcttcacatggaacctctctaaaattgaccggttactcagtaacatagcaaacctacacatatacaaaaaaattggaataaccctctgtatcttatcagaccaccatgctttaaagttagaattcaacaacaacacaaattgcagaaaccctacaaactcatggaaattgaataatgcaagattgcaccattccagtttcaaggaataaataaaaaaagaaattaaagacttcctagaatttaatgagaatgaagacacaacatccccaaacttatgggacactttgaaagcagtactaagaggaaagttcatagcagtaagggcccacatgaagaaactggagaatagtcacactagagaattaacagcacacctggaatctttagaacataaggaagcaaactcactctggaggagtagtaccaggaaataatcaaactgagggctgaaatcaataaagtagaaactaggaaacattacaaagactcaatgaaacagagttggttctttgagaaagtcaacaagatagacaaacctttatccaaactaatcaaaaggcagagagagagagcatgctaattaacaaaatcagaaatgaaaaggtagatataacaacagacactgaggaaatccagagaaacatcaggtcatgctttgaaaacctgtactccacaaaatcaaaaatctaaaggatatcgacaattttctggatagatatcacttacctaaattaaatcaagagcagagaagtaacttgaactgacctataacccctaatgaaatagaagcaatcactagaattctaccaccatcaccaccaacaaaaagcctagggccagatggattcagtgcagaattctaccagaaattcaaagaagatctaatgttgtaccagtactcctcaaactattccactctatagcagcagaagggacattggcaaacattttttatgagcctataattaccttggtacccaagccactcaaagatagaacgaaaaaagagaattacagaccaatatccctcatgaacattgatgcaaaaatactcaataaaatattggtgtattgaatccaagaacacatcagagaaattatccaccatgatcaatttgacttcatcccaggaatgcagggatagttcaacatatgaaactctatcagtgttatccaccatataaacaaactgaaaaagaaaaaccacttgatcatctcactagatgctaaaaatgcctttgacaaaatccaacatcccttcatgctaaaggtcttggagagatcaggaataacaggaacatacctaaacatgataaaagcaatatacagcaaaccaacatccatcatcaaactaaatggagagaaactcaaagctattcctctaaaatcaggaacaagacaaggctgtccactctctccatatctcttcgatattgtacttgaagttatagctagagcaataagacaacaaaaggagatcaaggggatacaaattggaaaagaagaagtcaagctttcactattttcagatgacatgataagttccctgaaaaactctaccagggaactccgacagctgataaacaccttctgcatgtggcaggatacaagattaaccaaaaaattcagtatccatagtttatacagatgataaatgtaatgagaaaaaagtcagagaaacttttgctttacaatagcagctaacaacttaaaatatcttgggggtaatgctagccaaaaaacttgaaagacatgtatagtaagaactttgagtctttaaaaaagaaactaaagaagataccagaaaatggaaagatcccccatgctcttggatatgtaggatcaacatagtacaaatggcaatcttgccaaaagaaatctactgattcaattcaatccccatcaaaatcccaacaaaattcttcccagaccttgaaagagcagtactcaacttcatatggaaaaccaaaaggcccaggatagacaaaaacaaccctgtacaataaaggaacttccgggtcatcaccatccctgtcttcaagctctattatagagccattatcctgaaaacagcttggtattggcacaaaaatagacatgttgaccaatggactggaattaagaaccctgatattaacccacacacctatgaacacctgatttttgacaaaggagctaaagttatacaatggaaaaaaagaaagtatcttctttaaatggtcttggcataactagattcggacatgtagaaggttgcagatagatccatatctaccaccatgtcctccccctcatgctaggctgagagagtatccctctatggggaatggactcacaatgtccatttgtacactaagtataaatgctgttccattaccaggggcctcatagactgtccaggcctcccaactgacacccacatgtagggggcctagtaccatcctaagcttgtttccaagctgtccatctgtggtccatgggctcccccttgttcaggtcagctgtttctgtgtgtttccccagcatgtttttgatccctttgctcatcattcctcccttgctacaaatggattccagcaatatagctcagtgcttagctggggggtctctctgtctgtttccatcagctactggatgaaggctctatgatggcatataagtacctgtcaatcttagctgtggtcatcattgtagatctctggaaatttctattgtgccaaatttctctttaaacctataatggctccctctattaacgtatctcttttcttgctctcctctatttttccccaactcaattttcctgtcattctatttcttaaagcatgtgcatatatgtgttgtgggtatgttccttccatagcactggtgtggaggtcagaggataactgttatagtcaggtgtttccttacaccatgtgctctgggcattgaactcatggtcagattcagcattaagagcttttactacttgagtcattttcctagtcctatggaattatagcttatatgaacaaatataattaggctatactaatgttgacaatgatgatgatgacatttgactcagattctgaggaatccatgtcaggaacatcagatagtgtgtgctaatttttagtgtgctgtaactgggactagttctaggatgataattaatgttagtgtgcatctttctttagaaccccatagagacaggttttggttgattccatatttaggaggtaattctatgaacaacacaaagcagaacctaatttgacagagaggagacaacgacacaaaaatatgaattgacaatctaggtgtctttattggaaagaggaagctaatttctgcttatccatgtgaaacagtggatagaaaacacagaataccattttttagaaaatggaattctaagaaagttagaatatttatataccaacctctgtcagtcactgctggagggtgctggggtgggaacattaattccacagaacttatgcctgcctgtcctgaacatacagagcaggctccactgaccagagaaagccttcagcaaagaattatagatactgaaacttggaagtattttaagcaggtgtgaaaatgttaagagctggagaatgtgagttgagtcctggaatacaattataccaaagtatgggttttggctttgttcttaaggcaatcatgttctcactgtcatatatttttccctaactacaaaggattgcatctcttgctaagactctgagctctcctttcttactggctcagtgatggtggatcccatctcccattttggaccttctgaaagaaagttagaagcatcctttacttaaaatatttatcgatcctcctccacaaaagtgttttaccactaggatatttttactcaaagatgagtgcaaaaaaaccatcttgcccatcatgttctataatcctgggtcgactaacaaacttctagcttgtggtcaaaagagaggaggtgtatgctagtatactgttggaaatgttgctttcagacatgctattcacaattctgggaatgctaaacaatttacaaggtaattttatcttagttgtaaaactgagaagaaatgacacatgttcctaggatgaacatgtgaggagaagcaatgaaaaactggaaattagatctggtttggaaccctgtttagcacaatgggttgaaatattaaaaaaaataggtcatgaatggcttttctgaagaattccctaagtaacaggctattaatcttctcctaagacaacccctttaattgtggtggaataaaatctaaggagaaaaatctcactgactcttctcactgatgacactgatgtagcaaagcctttagaagagtatgtagtcaggtgtagctacaggtttttaatatcctatgccaggtcttttagtataacaaaacaaaccagcaaacaaaaaactcagcttgcttcctaactatgcaagcaaaattcagggacgaatttttgaccttattaggtctgtgtgaacatcagtatgttcagagaaatgatgtagttgagtactaaagactggcccatctgctgccctgtgttggtgaggatggatcttccgaccaagaagaactgctttattagcacaaggaagttgaaggagaagtttaataggaagccagacaatttaaattgtttggaagtctagaaggatatgcacaaatgtcaaatatttgaactcaaaattgggaactcaaattggaggatgtgtcttctttagagtttaagacaagcaaacagaaggcatagtcacttacttcttcagaatatcacttgcactcctgttgagatgttctcaggtcattgacttttacaaatgatcaaacctcatataattcccttgaagttacttaaaacaggaaagcttatcatcactatgacacacatagatagtttctactctgtatgtattgaccaaattctctaaagttgattttatcctttaatgccaaatacaaggataattgacaacaatggaaataaaccctttcaaaggaatctcatgtggtcacacatattgttttgctgtaatgggattctgttaatatcaatacatttctgaaaatcttctcaagtttatatgatcaaaaggaaatagaagggaaataagtccctgagtacttaattagcacataaaattgcatttgagaacagaatgaaagaaagagatgtacaattttcttagcatttcaattccttcaagttctgcaaacttgttagttatacacacagctaggttatcttcagtttatatatgtctgtctttttttctgtctgctcagtgtattaacaaaacattttcctatctacacctatgtctattatgcacatcattaatacctgtatgtgtgcttagatttctaatgcatatgctgaatgttatcacacattttcagccaaggcaatctggtacagaggccaactgtattcttttggccagtgagtcttggtgcaccatactgcagatgctttcagtgaaaatcacactttctagccatgggtcagagtaaatcctcaaatgcattgtttttacactgaatttcttgcaatttattttattctctggaaaatattcctgaacccaaatggaaatacacaaagaaaaacaaattgaaaaattccatttggcaaaactatacagagattaaaaggaaagtcttgaatgaaggttaaggtgtggcatgtagacatgctgtggtcaatttgtgattggctgaaattacttgacaccattaccataatcataagaatcattatacattggagaaacaaataacaattattcaattgctattcaattgagacaagtaagcaaaatgaattcaaatgctatattttgatttctgtgtgtttggagataatataaatacaatttctgatatctaagtatactaccatatgtaaatcattgattcatttgggaatgaatcagatgtgttgaagaaagcatccttttactgtcagcccagacagcaacccaacagggtgagtccactggttggtgaaagccactgaataactgtatcttcctgttagacatgaggttcagagaactccatggctcaccaaattcacaagactcaagaagctcttcctggaggttgtataaacaattaatacttgttgggaaaggagaccagtcattgatggagatgcctgaaagtttcacaggggactcttgggatgaagcattcattctttagtggggatttttgataaagaagctgtctgtgaatcactcatggtctcttaagtaacctggtcatctcattggtctaccaagttctgctcccctttctacccatgctaaaggacatttctgtgcatctctctaaaatatatatatataacaattatgaagttaaaaattacaaccaggagacaaaaagggaaggaaggaatattgctagtccaagctaagagaagcctagagataactttcaaagcaacatatctccagagacaaagaaataaagttcttttgttggggcaatgtacattaatataagaataactaaacacatggagacacaagtccattcctgagaatgctcagttggagatcaggatgcacacatgttcaatatggtagaaagggtctcctccatggttgaaaatttagtattacagtggaaaaagtttgctgaggatgaatgaaaagggtaagattgagaataattttgtctagctccttagaaaacagaccagaagaacccaaccttccccaaaggcagtttaggattctagtattaatattagacaatgtttaccaggtaagatgttaatttcacataagatctgtgttgaaaccattgctccgtgttttcattccttcaaatgattgaggctatcatagttgaactgcttggttgtgattggcaatttccaatgggaaaataaaggccagattgtggccatgcttaaactctaccagttcccagtttggtggaactgtaagtctctctagagtagatactcaatgtctagaagcaaccaaaattctaaatgctgccatttttgcagggagctcagcagctgccaaagagcaaatctttaatcacttattttaatgcagtgacaacctataactaaaagaaacacccaaaactgtgtgagtaaaatttaactagctgcagaaaccttgtagatcctttcccatagcattggacttgtcacagctatcatggccaccaatggctctatctagtagcttcttgtacccaataacaggtaggagaaacctcagtgcattcctgataacttcagatagtctttatatgactctgcaggtagctgttcagatggccttgttcatactttggacttcactttctggtcaagtaacttttccaccaccatttctgacagctagaacaccttctcatgctctttgtaagtggttctcacctcactctccatggatcatccagtgtcttctttcctgttcacaatttgcctgtgttgcccgagtaaaacctctgcaaattttggcttgtctttaacacaggttgaatgggccaaactgtttgcatcaaacaatgtttttattcctatagctgccccaggataacctagctgaattggtgagagggtagctgaagaattccagaaagcaacagaattgaatctggagatagaaagggctataggagtactaagaagggcataaaactgtggagaagattacagagatcactcaagaattgaggctacagaaaggccaagagtgtagcagcaagagacctcaaggagctgtgacattttgggggctatagatgccagctattggaagaattctagggagctcctgagtcacccatgatgtctaaaggctaagggccccagtatccagagccttcagctttaaatctagaggctgggttctggactgattgcacttaaagtctgcaatataagcttatggctttgagaatgcagagctataagcttcttgttctcaaggctcagagctataagctcatagctttgaaaaggcaattcataagtctatggatcttagagtcccccaaggatgctaacattaaggcaattattcattgtctgtttgtgatatccatccaaatgtagcaaatgaacccctcaggtgatctgtgacacttgtaggttcctccagagggctttatctgaaaccaaagatattatagaatccataatagttatttggaggtgaaatgctattctacccagaagcattggcagtaaatgctgatgaagcctgcttgtttctattcacttcaacacagtcaatggagtttctttcagagtttcacaaatgaaaaagaaaataaaactcaggacaactacttttctttaaagtagctaaactatttactttttgatgtgtatgtaccacagcatatgtgtgggggccagaggatgatatctcattcttccccatgtacagggtctctctgctatctctccagctttgggggaatctcccgaccctgcctcccatctcaccacaggagcacactgattacatacttgtgctgttttgcctggcttgacatgggttctacaggttttaattcaggtccttatgttgacatatatgtactttacttgagtcatctctccgcagcctaagattactattttttaccagactataaagccataattcaggatctttatttaatgtatgaagtattattttaaataataattacttgtattattaaataatacatttatctcattaaattatatatataatatatataatgccttataccattattaaacagcataatttttgtaagccacctaatattttctaagctttaaggcaggattttataggattgatgtttatatatgaattgtttttaaaaaatgaccaccacttctttcttcttaaaatcttctttatacaaactcttttgcaagcaaagtatatctaaaattgacttttttcggcaacattattaattacagctggactctgtcttgacttcaagcaacaccagaatttctttttagttgctgcaaaagaggaaaaattaaatgaaaaaagtaggaaaaatgaactacttcttagttagcattctttttcctccctccaaaaaggagacattgctataatactaactttttaatttatacttaatgaagcacaacagtggtttctaattgctattcatcttaataattaatgaaattacattgttagaatttctatatgtacagactgttcttgacatgtccagtgtgaatactaatgaagaaagagccacagtgaatggtacttcacaaggttttggagttagcattcactccatggggaagctttggttctctgccttaactaatgaagacctgagatcaaacacagagccctatgcaatgccatctttcaaggtagcttaataagcctgaaatgtcaagtgaaatctcctaaaaatggagtttaagctacaataatggcccatcacaactgtcaagctagttcttcaagtgatatatatttaagattgatgatatgctcaggaaagtgaaggacttctagaaaaatggcccaaagcaaattgttgatctcaagtacaaaagagtaaacttaaccaaagctgtcatggaagcaacttgtcttgtcccattaaaacaacaacagcaacacacacacacacacacacacacacacacacacacacaccacacacacacacaaaaccacaaacacacacacacacacacacacacacacacacactcacacacacacaatacacacacgccctcttcagttatcatacatatttgttcttctcagtaaactttaaaagtatatcatcagacttcaggaaaacctcatgttagggttcccaaatagaagacaagctaaagaaaggtgggaaaacaaaaccctgtgccactccctaacagcagctataaccaagtagctgaactctctctcctagctgtacattctaggtctttcaggtagaatacactattgttgactgtgtggcacacaaagggataggatagtctgtgcatcctataaaaagagaagtctcgagaacacagaaagctgagattggggctggttcctgatcagataaaattacttagcattgtcctaataagaccattattttctctgtaaaagtctgttagaattagtaataataagacttaaaaaaaatcctcaatgtgtgtctcaactgtagtgtaggcagttaagaacagaactgtgaaatctttgcaaagtctgtgaactgaacactcagtactttgctttggagatagaaaaggcaaaaagacaagcttatggagaataattaattaatgtcagaaataatcttagaatagaaaaattagttcggtggaaaaataatttttaatttctactaaatcagaaactatttaaagactgaaatggaaatgtgaaagacccttccctaacaatgctggtcatctttgttgagcacaagaggatttagttgtcctgattacttgttcatttgtgttttcactcatatacttactcattcgttgattgatatgttcttttgtccattcatttaaataagattttctgctatttcttaggtcctgggttaggcattgaacacttacacatgtgtgcagcagtgcctgcttttgaatagttaagctgcttgagaagcccagaaatcagtgttataataaaaaatgtagtacaaatgctcaaaaggagcccagaagtgtttaaacttggttgttccactgtgatgatgatggtcaagctgcctttcaaagagggcatgttatttgatgtgtttaccttgattagctgaaacatatcagggaagctacaaaatctatacttaatgggaaagactatttcaaggaacaatgacatttgcaggtaattagaaatgaaaaatttgagtctaattttctattctgcttcacataattgcatattccaggcaataggtaatcagatttatatgcaatgaatgagcagatcagtaaatggaataatatttcttaggaaaagtgtgaatatatttaaaaattatggcagtcttggttctaaggccaaaaatacaagtgaagtaagctccttttaaaaagcactgaacttccttctgtagttacttaataattaccaagcaggatatgttaaatgagggagtcatagtttctcactaattagtaataaccagataatacatttatttcttgtaggtatactcagtgggaatcccaagaaggggctttattccagaggagacttagagtactagcaatgaactgtgagaagccagtacagagagaagaaagtgtgtgtaaaactacaaggcactaagaaaatgtgaaattagattcttgaccattcttcagaagtactatgggggaaagtctctatggcctctggtaaccattgttccattctccattctagtgatgtcagctgatagattctacagagaccatgcagttgtttctctgtgcctggattatttggaaaatacattgacagtccaactattttactattatggtttacagagtacttttacttagtggaaatattattattaacaacttgtggagatttaaagaagccaatggattcactttattgctaaaatccattactaatatatttggctctttttaaataaacaaagcaaaagcattgctttaggtatttttcctgtcactgtaacaaaatatccaacagaagaaacctaaaggaaagaggatttattttggcccatcatttaagaaggatacaggttatcagagcacagaatacataagggttggactctatccatgatagcaggagcttgtcatggagcttgttacatcttgagggatcaagaagcacagagttccagtagaaatggggtggagatttggggttgttgtaaattatgaggattgctgatggggaatgtactgtgtatgtatatcttattgattgttaaagaaaatactgtttggccaatgagacagcaagttaggactaggagtcaaagaggattctgagaaatgtagtagataagtggtgatccaggcagaaagtgacatagcaaggagactcatatttaaagaaggagaaacaggaagcatccctcttttcccctccgctcttgctccagtggcacaatgtgatccaccggcaaggagggatgccaataaggcatccgataagataagtcttatataatatataggtttatgatagttaagtttgagctaacagatgagaatcctagtcattggccaagcatctttgtacctaatacaagtttgtgtgtattcatttgggccctaactcaggcaggcgactggcgtaaagctcacaagtggcagtggggctcaggcggcttttggcagaaagatttatggtaacagattgcctttgagagagccactgttctttctaggtcccacattttaaggacttcacagtatcctctaaacagctaccagctggaaaacaacccttcaaccacaagcttacagggacctttctcactgagaccacaaccaggatatgtaagaatatgtccctgtcaaaggttcatttcaggcttgatttatctctctcttcaaatagattgctcattttcaataataaagcagtttgaattttcaggcaaaaaatttggttgaatataatcttttaaaatttaaattagaaacaaattgttttacatgtcaatcctagttccctctgcctttcctcctctcctgcccacccgaaactaacatcctacctagcccataccatatctgctccccagggagagtgaggcctgccatgggtgggtcttcagagtctggcatatcttttgggatagggcctaggccttcccccatgtgttttggctgacagagtatccctctaagtgaaatgggatcccaaagtccatttctatgctagggataagtactgatctactacaagaggccccatatatttcctaggcctcctcactgacacccacatttgtggggtctggaccagttccatgctggtttcccattgatcagtctggggaccaagagctccctcttgttcaggtcagctgtttctgtgggtttcaccagagtggtcttgacctctttgctcatcctggtttttctgcaatgcagatgttgaagttaatatcatttgtagattatatgtagatgtcatctcagaaagcagaggtgaggcattgagcaagaaaagccaggtagaaggaagatctagagttgtatgatctgtgaagtagttcattcccatagacaatatcacatttttttttttttttggcaacttgagacacctcagaatgtgcaagtttccaaattcttactctttggtcctaatcattcattgttcagtgtgagtgctatacattctgtgcgaagcaaacatgtcatagcttgtaacaaaggcagttccccatggacgtcacatactgtggttcagaagagacttgcatgtgagggggtggagaagcaatgcatataatgtgaactcaagccaagactgaaggaaactagtcagaattagtgaaaccaataatatagggccaataatgataatgccagtaggtacagcaaggatgcagtatagggataggaaattctgtttgagaagtgttcaatttaaatactgcacattttttaacatagaaatactttataaaaggtaaattcaaaaattcataggtactgtgtacttattgactgaaacatgacaaattagtacagctaggctcctaacttcatcttgtctactcttatgttctaaatctcataattcttatgcacctgtggtggtcctcctgttgtcattttccccaacacaacttccatcttcctaacattcctaacacattcccatggctcctgcaccttccttatcctccagtcctgtcttgaatgtttggtacttgactacatcatccaaatacttcaaggaaacaccattcagctctcttccttctgcttattaaatgagcaccattttttcttgcattattgatatttacttgttttatctaccttataacttcaaaacctgtagtctatgtctatgcccagtagcgtagtcaataaattccatctgaaaatataatattactgtttactctgccctttctctgctggtttgttttatcacccaagtatttaaatgcagattaacttatcattataaattgagatttttattaacctgtgagagaaactgtatacttgaatctatcagtcttgaaaagtgatgtgttgcattgtacatctggtatgtttgcaaatcctccaattattggtgtatgatatgccagacaattttttctatagggaaaaggtagcctctgaatgtggagaaagggatcacttaaatctgtggttcatgactatgtttcagtcttcacataaatctgatgttatgataatgtggtagacaataatgccattgcatttctgaattaaatgatatgattcacacattgtattcttgctcatatgtagtatggccaatacttatgaacctgataattggtggttatagactaggccaccttagcaacatagatttccaggctttcattttggacacttcaaagggccttctctaaatcacagactgacaactcatgatcacttaggcatttctaatgtatgagaatactttctcattttgcacccacacacatcttacaacctttgcatagtaacatagatagaagattcatttctctattttctccctgctcttctagtacagaacagcaattaaaactgaaatgtcctttaactaaaaactagtcaaattgaaatgtttgccatacttaaatgcaacgaacttgcaagttcttgaatttttacaagtggttgacaccacctatccgctaatcctccttagacacattttatagagaaggtttactacagagaatttaaatactgattaacttcaaagccataatgcacaactgaggtatagagctttttaaataactgatgtggcttgaatcaatgatctttaaaaaaaataataattttcagaagatttcggattagcccaacaaatattcatctgcagagcaaacccttaatttacactcaaataggaacagataacaaaagctactttggcattttagttactgtgtttattgtggagcagtgagcacacagcagtgcaatctagacattcagtcctagatacttctgatacaagcacagtggaaagtttctttcccttggttagatatatctgtggagagaaatgcaagggcttctggattgctgcctctcattgttaataaattcaatgtgggtatatttccttttgtaaccacaacctactttctcaactttccctctagaatatgccatttcccataattcaagcactaaaaccatagatacatttcccatcaacttttactgttacttacctcctcatctgcatttaatcccaccatggactgtaataatgacactgcctttcttatttggttttagtctcctggatgcagtacatcatgcttaaatgaagccctgccttctatgtacttgacttgtgcatatctacctgtgtttctatataaatttccacaccacttcttagaatcacactgtatccccctcttctactgctctaataaatggctatttcatatacattctctatccttttcaaatctttgctgttatcctcaaatcttttccttgtgtttcactaagaaatggaagttgtcagagtgaacttccccatgatccatgacttcattctctaactttgtcctttattccttgagatattataggttagttgcttgtgctatgtgtaaggacagggcttttctctgttggacttcagcttctggtctattcaacaactattttcttatttcatccttagattttttttctttcttattggattgttgccattgacatgcaaattttctgtttcttctctcatttgaaaagaaactgtttgctaatattttatttccagctaattatttcctaattatttctcatagcaatagcaaatccttcaaaagggacttctaatcttctctcttctattctctttcaactactatatttttctgtcctcctatgtgactagaaaaaaacactaggcttgctgttagcatttgtaatgtttaatccaacaatcaattctcagtctcttttaaaaaaatattttatccttttttgtgtgtgcatgttcatgtgtacatatgtagaggtcaggggataaccttctggagtctttacccttttgccatttttgccaaaccctgacatgaaactcaggtaaatagatcttggaggtctttgttcactgagccatcccatcggtcccagttaacatgctttatcttcttgtgtcaatcatcatttggcttaatcactgtttacttctggaaacactgcacacccatcactttcaggtcttctgctgttggactggctgctcattttcagtcttcctattgaagtttcctgagttttattcactgactcttctttatccaaagctgctatatggtgttatcccatctgcacccatggttccaaaatccacactgtgctattattatttccaagaggtaatttcctgtgtttttgttgatgactagcagattattgtgctttaggaaaataggtttggttttcacctgcttcctcctacctatatgtagagtcatgatggctaacatactgatttgtttgtttctttccctcccaacttcaggaaactgatgaatgatatttatcttttgcagaaattctgattcaaagaatggaaggcaccattgttgggattaccaggagaatagaagaagagaagtgagtctcagagctaaggttaggaattgactgatggcagtatagaagatgaggggcacttaatatctgttttcctagtaactcaaacaatcacagtcactgaggattctaagggacacaaagtgaacaaagctgtgaaatttcaacataactagctatattgttatgcagagaatcccaggaatcatttgattatggtcactttccacactgttaattaatgttacaaatgaataaaaatgtataatattttatgttcctgaggaaaattatattacttaatggtctcacattttgcacacattgcattttgccctttggacagttttattacaattcttactgcttgctttcttctgaggggagaagactcttactacaattcagttagttcagtagcctgtcctttacatttctcctttgctgcctttatgttcttctaaatccaagtgaacccactctggcctattgcagacacctccctgagtcctctgaacccttccaggattgtccctatcattaccagtctagaaactttcaatacttccacactagcccctgcgctaaccccaatgtcacagccacagcctccttttctgctgttgttgtcaggtgtcacttgagctgacactgggttactccaggtttgatctcctgaaatcgactctccacttccccacagctcttgctcagaatctgaattcatcactgcacccacgtcctaagtgtatccaaacatcaggataatttagcagtattttggcagactgtgaaggtaattggtggtgcatttgtgttgaaaatatggtcatattccagctgcactttttacatgatgcatgtataacaaagttccagtatttaccaaatcacccccaaaatatatatgtctaaggctaaatttagagtagtttgttaaaggcataacataaaagtatgtagttggtattggtaaattgaaactattatggttcttattactataaaataaagggaagtgaccaaaattaataaaagtaaattaaattcagtttaatttttactaaatcattgatacttcattccaaattagatatttcccttagtccacacattgatacttggtcttcatgccgtgatcctcattttatctgactccattttattggatgtttgattaggtttgttgctattctgtttcaggatgaaatatcctttctgttgttgctaataaaactcacagacaggaatataaaacttgcaaactttacgctaaaacttgtcaaccttataacaacacacaggaaagtcatcatgcttttaaatgttgtatgaattcgtgaaacacatttttcctttaaaagtattgagtatgtctattgttatcctagtttagttcatgtttagatagttatgttgagatttgtatgggtttagcttctaatattgctagcagacgcagtcttgtagcgaactccctgatctcctggctcttataatctttctgctcccccttctctaatgatcattgagccttagatgcaagagggagaaagcccatgacacctcaaccctacacaaagaactacaagcaaataactaaagcttaaagtgggaaacatattctgtccctgggactaacacaccaattggttatctaatgccaaatcgtcagccctgaaaacatatatacaagcaacattatacagacagagcatgttatatttagtaacacatatatgcatgcaacaataattaataagcggccatgaatttaaagagtgcaaagaggggtatatgggagggcttgatgggaagaaaaggaagagaaaatgatgtaattatattataattttcaaaataaaataattttaaagaagtactgagcattattgttgaaattttgaagtctattaattggaaaaatcccgaacgtaaatcagaaagacagaaaaacagttgagagtatggcacacagatgccagtaaaaactgaaagtacataaacaaatatgaatctacattatatagtatcttacaactccctcccatttgaaattttgttaataaagggctttggagaaaacttttacactgccattttaatgagtacatggtattcagaaaatagatgtattatggtttatttaaccaggctcttatagtgcaggattggctattttccatttctgttataataaacaatgctgggatgaacattatatacataaatctttatgcacatccttaatcatttctttacaataaattactaaaaaaattgctgtgtcaaaacatatgcagattttacttatttactgtaacccagtttttaatcataatgtaataaatgcactttagaaacaataaatattcaagaagaaagaatagcaaaatatgctacaactcacatatcacttcagagataagaatattaatatattttaacgacttatttttacaatttttattggcattcaagtgtattttagtatgcatatttatccatattaatacacgaggctaataaatattgtcttttgtatccttatgtttccactctgaaatactgactcataatttcacctcatgcagagtataacatggatatataatgttctatttaacaaaccctttaccagtcagctttaggttactaattgtttgaactttataataggtattcttgtacaagtgtctttgcaaatgtgtaaaagtagctactcaagaaggtttctaaaaagaaaagcactcagtcttaaaaatatataatttatttgggcagtggtggctcttgccttttatcccagcacttgggaggcagaggcagtgaatctctgtgatttcaagaccaacaaggtctacagtactagttccaggacaggtaggtttacagtactagttccaggacagctagggctgtgatacagagaaaccctgtgtcaaaaaacaaaacaaaacaaacaaaagtatgatgtagcaaagtgttttatggaatattcaagagtgtatcatttttttgtgatgttatttctagtatgtgatgtggataaaacagtgaaatctgaataaaaatgatcttttcaatttattagattctaacattaaatggtgaacaggtatctttgattcctattaaaatgttgaaatgccattgttgtccaggggagtattgaaccctgtgtggttaacacctgacagttctggtctttaccagttaactctattttttttcattttttaaaatttaaatgaaaaacaatcttatttcatatacaaatcccagtctccgcttcctcccatcctcccactcccaacaccatcttctcatcccatgccctagccactcctcagataggatgaggcctcccatggggaatcatcaaagcgtatcacatcatatactgaaggaccaaggctcccctacttgtatttagactgagcaaggtatctctccattgggaataggcttcaaaaaagcccattcatgcactagaaataaatattggttccgcttctagagcctccatagattgcccaactctcccaaatgacacccatgttcaggggacctagtttggtactatgctggtttcccagctatcatggtgtctgtgagcttcctgcttgggtctgctgtttctgtgggtttcccagctaggtcttgatccctttgctcatcacttctccctctctacaactggactctaggagatccattcagtgcttagctgtgaatctctacttctgctttcatcagctgctagatgaaggttctatgatgacttttaaaggtagtcatcaatctcattatagggggagtacatttaagatagactctccactatcacttagattctaaattggcatcattcttgtagattcattggaatttctctagtggcaggtttcttgttaatcccctaagggctctctctatcaaggtatcccttttccttgttctcctctgtccctccccaaattcaaccttcctgttcctcatgttctcctccccatacccttctctcctcctctctttcctacatcacttccccctccccctacactcccaatttcctcaggatatcttgttcctttccccttctcagagggtccatgtatgtttcctttagggtcctccttgtttcctagcttctctgactgtgtggattgtaagctggttatcctttgctgtatgtctaatatccacttatgagtgagtacataccatgtttgtctttctgtgtgtgggttacctcactcagaatgggttcttctagttccatccatttgcctgtaatttcaaatgtcattgttttttactgctgagtagtacccctttgtgcatatataccacattttctttattcattctttggttgagggacatctaggtttcttccagcttctggctattacaaataatgctgctctgaacatagttaaacagatgtccttgtagtatgagtgttcatcctttttgtatatttccaagagtggtattgctgggtcttaaggtagatagattctcaattttttgagaaactgtcatactgatttccaaagtggctgtacaagtttgcactcacaccagcattggaggagtgttccccttactccacatcttctccagcctaagctttcattagtgtgtttgattttagccattcaaagaggtgtaagatggtatctcagagttgttttgatttgcaattccctgatggctaaggaggctgagtaattccttaagtgtcttttgacccttgagaatcctctgttgagaattctgtatttagatctgtaccccatttttaattggattggtgtttaggtgtctagtttcttgagttctttgtatattttggagaacccagcatagctaaaagaatcctgcacaataaagaaacttccggaggcatcatcatcactgacttcaaactctattatagagctatagtactgaaagcagcttggcatttgcacaaaaacagacaggtgaaccaatggaattgagccaaagaccctgatattattccagacacctatgaaaacctgatttttgacaagtaagctaaaattatacaatggaagaaagaaagcttcctcaacaaatggtgctggtataaccggatgctgacatgtagaagattgcagatagatagatatccatatctatcatcatacacaaaatttaagtgcaagtggatcaaagacctcaacataaatccagccacactgaacctcttagaagagaaagtgttaagtacccttgaatgttttggtgcatgtgaccacttcctgaacataacaacagtatggacaccgagattgacaattaacaaatggaacctcctaaaactaagacgcttctttaagtcaaaggacacaggcaacaggacaaactgtagcctataaaatgggaaaattcttccccagccagttaattctgaagactcaccactttacacatctccactgatgaaagtaaactacctcagtcatttcacatgtgtcctcaaacaaccccattctcaatgaaatctcctttaaaacctttccttagaattgtatcatatattcataaattcctgttcctgtgatttcttttcttaacacgaactgctctctctcacaatctgtctttcatataatatcatttatttccattatcagagcatagacatcataagggtagacatttttattaatatagtctgttgatataatcttcacataaggaggtttagatcagagtaggcactgattaaatacagtccacagatgtaatgtattattcttaaagggtgtctcatctctgctggcaagccttttagagttttaatggagctattctaaaacaagagtacaatatctaaactaaacacctcatcctagcaaataaaaaccccactacaaggaatgggttccaactttttgaattgtagctagttgagctagatagacctaccatgcaatacagagtattgctaatactcttggttaccctccagaacttgactgtaagatcttattgctgaacatatcacataattgagtcacggggcacaggaaattaagttccactcacctggaagttactgactatggtttttttttttttttttttttgtcacataattgagtcacggggcacaggaaattaagttccactcacctggaagttactgactatggtttttttttttttttttttggttggtaggtgctatgaatgttcagaggagagaagcaattattttagcaagctgtgaatcttccaaactacaagaacaactggccagacaagatatgcccactgctacaatagtagcctaaatgttatgggaataactaacctctttttgattggatctaaagcccattcctttcagtggaacccatacctagcactattaacagggccaagaatgtatggttcaattaatcccaggtccttgaggcaaacctggtattattttgttaaatgaacacggtattaaagcaactattagtgacttattgctgggaatctagcttctattttcaggagaagagattacacagagtgcctcaactggttaacatgcagataataggagacagtggagtgttctgctcctaatgtgacacacataactcacccttccctcaaaggaaccagaaccatgacagcattgtgtgtgcaaagaacttaagagccaggagttgtgggattacatcagtgaaatagtttcaggatacaacagggcagttgtacacatgaatgcacagcaataacaacaactgctcaagatgtacacaatctccagctagacaaaaatcccatcattgagaggggtggttggcccaaaatcctaccactaactgataaactattggagagagtaagttttctttaatgctctgtccctggtgagctgacctggtgagtggtcagctcaccagggcatgtctcaatcccaatactagtggagtaacacaaactacacatatggagaaatgaaaagaaaaagaagaaatttcacagttggtaggaaggcatgggggtggagaatatatttgaaaagagttggaggagaaattggggtcaacatgttgaaaataaattgtataaaattcttaaagaattaataaaatattgctaacacaaatataaatttaaaaagttataaaataaagtgaatttatagcactaatatcctgtatattctcacttgtaaatacctcagctttcagaatactggaaataggtttgtccaattaagcctactttaatttatatatcagcaaaacagtttagtccagagctaccattttccacccattcaactcacttatttgttcattaaattttatgtcacttctcaagtctctgctgataattttatcatgcagaatttttagtttttgatattgtttccaaactaaggttttgttaagtagctactagagtatcatctataatcccctaattccaataaaagccacataacagcaactaggatgatctattgagtcattaaaattatcctgtccataaaaatataataaataaaatataatatatgaaatatgtcatgaacatcatttgatacaaaaacaaaattaaaatcctttgaataagcagcatttttgaatgtttatgggatagtccatgaacatttgcagtaattttgatagtttatcaaacaattttaattaaagtaatttccttatggagcaataatgtcactcataaaagtctgaaatatgtatttaaaatttcctagagttataataatacaagctgcaaatgtaagaataaaagtatcccagttacacttgtatctgttacactgtgtttcctccggggcatataacttttagtacaaggaagtgtgcccatattctcacagaaaaagtcagatgaactttggtaaatattaatttgcaaatttcactcttaagagaactaccattagcaataacctgacatttataactattctaaataatgcaacaaaagcattttcaaggttcttgtgctgcttttcatatgcagactctgcagttctcttcaataattcagcgtgtttggacacatcttactgaatcatactttttgaattcaaacctcccttgtgatgaaagccatgcaagcatttgtagaaagtcatagttttgattctttgtttgatatgacactttcattttgtttggcctgtctgtttctgctcagatatagatctttcgtaagcaatgctatttgtggacatgctcttctgtctctttaattaattaaagcaacatctgtctagctaattggctaagagtctcaagtcctaagagtttgaagcctaatgtggcaatatagtccctcaataacctaagctttttagtggagctctgactctgactcccatgcttttgtttcacctgactggctcacacaatatcttactctttctagttcactggtctctgcccattacttttttactctaggcatgcattaatcttcaatgttatgactaatgttacttaatcctataagaaatgaaaatgtaaaataataggtaaaatgtcatatgaattctgtcttgtgtttttattggtcacagttaaagtaatatccacatataaaatacattgttttgtataactactatatatcatgcttattgcattttaatacaactcattttgattgtgatgaaattcttaaaacaaagcttagtgacaaagtcgtattttatataatcatagcttatcatggtttgggtaaaggaaacattttacaagtaatgtaacagtctgagcaagttgtatttagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataggtcatgaattctaatgagaagaagtacatggcagatttagaaggaagaaagagaataggcaaaatgtaagatgtaattagattataatcacatatgattataaaagtaaatatttgataaccatttgatgtgtcctcttccctggggaaagctaagtctccagcttttggtattctttagtttcttgtagtcctttgaataaggttgagactttgttttaagtaatctttagtttatttatttttattttatgttgattggtgttttgccatgggtgtcagataccctggaattagagttacaaacagttgtgagctgggaattgaattccaatactttggaagagcagaaagtgctcttcattgtggaaccatctctccagcccctaaggttgagactttgcgtgcctttccctgtccactacagcatgcctgttaatatctttcttgctcagcccatgtttggacagtcatgtgggtgacactttatgactgtagcttctgacattactgggagacagaacttcacagcaaaaatccctgatcccctgactcttataattttaccacttcctcttttgcaatgttcccagaatctctgggtttgagaatgtttttcagatgtgacccctgggactgggagtcacaactatgcattttgattggttgtggttttctgttgcaaaaataagtttccttgaagacctcacctttctgtgggtataaggacagatgtttatattgttgggaattataataattgatcagtcataaatatatacatacaagtaacattgtagagattgagcaggttatatttatatatgtatacaatagcaattaatgaaaaaaaagattctggtttccgaatgggaataaaaaaaggaaaaaagaacatgaatttatttgaaagagagtaagaaggattgtctgggaagtttcagaaggacaatagggaagggatacatgttgtaattatgttataatttcaaaaataaagcaaaagaatagggaatacaattttaaatgacagtaaaatatattaacatttagtttaaaaaggaatattttagaataagacaactaaggtttcacagcctagttctctctttttaatagctgtagaattgcaagtaattttcttaataacttagataatattactcactaagtcagtgtcaggcatgccattaatgaccgacaaatagcaggtcttaactgctatcattataactgttggctaaagtattacattactatttctggtactacccactatctctaaattagaagcataaagaataaaactgataaatataaatgataattgtgaaacattggtggttctatggtgggaggcattgtttatttgtgccttaagctatgttgaaactttaaagtcaaatattaaaatgttctcagtcagatatttctaatcatgtatcctcttcaattacaaaaattggcataattcagtgtgctcaatggctaaattttgttttgtttttcttttatcaatgaaaatgtaaataatatttattttagcagatatcaaagacattcctttgacttagaataattttagtctaataggttgttattacttgaattcatgaactaatatgcaaaaactcattgtgtctaatatcaaataaaacaaaatttcaattctaattttgattcaaattagtctctttaaaaaaatgcccttcccctataatgagactgatgactaccttatatgccatcctagagtcttcatccagacgctgatggaagcagaggcagacacccacagctaaacactgaactgaactctggaacccagttgcagagagggaggagtaatgagcaatgaagtcaaggtcaggctggtgaaacccatagaaacagctgacctgaacaagggggaaccacatagatcccagattgatgcctgggaagccagcatgggactgatcaagatccctgaatgtggatgttattgagatgccttggcactctatggggcctctggtagtagaccaatatttatccctggagcaagaaaggactttggaagcccatcccatgtagagggatgctctctcagcctggacacatgggggagggcctggaccctgaccgggatgatgtgacagactttggggatcccccatggagggccttaccctccctgggtagaagaggaggtggggtgggggtgttggtgtggggtggtgaaggaggggagggagaaggagcagggattgacatgtgaagcaggcttgtttctaatttgaactaataaaaaataatttcatgtaaaaataagtggacttcaattttttagtagaattagaaagaagattattttacatgtcaatcctaggtccatctccctcacctcctcccttgccccgccaactaacaccctacctatcccataccctttctgctcccgagggagggtgagatcttcagtaggaggtcttcagattctgtcatatcctttgggatagggcctaggcccgcccccttgttggacttcaaatttaaatgaagagcaacagtgaatatttgaaataaatattaaatttatacaaaaatcacatgtatcccatgtgtatttaggaagcaacccaagatgaattttaatttcccaggtttatcaagttcctgatgtaaagtcctcctcacattgtttattgttgaaatttttcttaaataaaattaaaattgtgttgtttagcctaccacatattattatttcaaatttactgtctctattatgagtttactcatgccaacataggctttcgcctttttataaaatctactgaatttgcatccagtgaatcatttctaaagttgaatccagagcaatgccaaaaagtgaaaatgattctgatgcaatctgtttttcattcctgccactacacacagcagaagttactttatataactttattaggatatattttgaccatatgctctcaaagttaaaatttaaacaaattaccaaactaaagttctgtaaaatatgtaacttatgtgataggacatggccacagtatcattacagtggataaaacttttcaccaaatggaatgactaaaagttgctgtgggctatggcaccctaacagtgtgtttgcctccaagctgcctattacagaacacaaagaagacacacatgaataacactatatcaacctgaatgtgaggtgtcaaatctaatttctcaacagtcaaaaaattttgaatttctagggagagtttttgaactaagcagtaggtattctttatgtctgacatgaccttttttatgtttgcaaaaagtttatatccctgtacaactcagacactgaaagaaaaaaaatgttatttagaaagcatgttttgtttagatttatgctaatttagaaaatattatacacctaaatttaagaattatttccatgtttcctgccaggaggtataactaatgcacagctttcaacattatcatgtctatgcattttcacactgaagacatgttggaactgaatgtaacctccatatttaaggtgtcttagaatagatgatgtgggcaattgcattgggaaaaataatgtttcaaaagataagcagcaaagaggagttgatttctagttacaatgtctacagtgaaattgctgctgatcaatgaaatagatattactccttgtgaagcttttaaacacatagaagtatttcttatgtttctctactccataagagattctatagaaggtgagagcataatggcaacaacaactagaaaatatatatctatgggagctaaagtgttgagtctggttaccaaatttttaatcctagcacagagatttgaccatttggatccacatctcttaaacatcgaaaataagaattttctagaagcttgcttagttataaaatattttgagtcagtaagaagcaaaagcatgcttatcagcaagttggccaatattgggatatatagaccatttatccaattaacatactgtatctcatagtctaagacgctatcaaatatgagatgtgtttctaaatattcttttaagaagtttattagttaaatttattcattaattttatatcttgactgcagttctatctcttctgtccttccattttgtccctaccctgcccaaccacacccctaaattcaatcctcgtctgtttctgttcagaaaagggtcagcttcctatggtgttaacaaagcatgtcatatcaagctcaagttgaggtaggcctgaatcccattccctcttattgaggcttggtaaagcaacccagtaagaggaataagttcccaaaagcctgccaaagtgtcagggactagccccactaccacaactaggagtcctacaagtagaccaagatatacagctgtcatacatatgtagagggtcaaggtagatcccatgtggactctttagcaatccttcaagagtctgtgagctcctatgagcccaggtttattgtctctgtgggttcctttgtgatgaccttgacttcccctggctcttacaatccttcctccctctcttcaacaggattctagaagctctacccagtgcttggctgtggatctctgcatctgcttctatcagttactgttcaaaggctctctgatgacaattaaggtagtcaccaatttggttacaggagaaggtcagttcaggctaacttttcactattgttaagtgtcttaggtgggaccactttgtagattaatgggagtttcccttgcactgggtttctacctgacccccaagtatgacatcttttctattactctaccgctttcttccacccccagatcccttctcttttcccctcaaagggaaatccacctgttcctctttggtatctccttgttacctacactctctgggtccgtggattgtagtatggttatccttcactttacaggaaatttgaaggcaaatggattgaaatggaaaaaaatcactgagtgaggtaacacagactcagaaagacaaacctgatatgtgctcactcataagtgtatattagctgtagagtttctaaataaccttgagaaagaaaaacattcaagccatataatctcactgatctgatgatgaatggtagtttacagaagttaaaactgtgttcatttcaggattactggaatatttattatgcatcactaccaagttttgacatcatctggataacagattaaaaattaaattctagtaaatgattcaaggaactaatctcattatatttatatccaatactttcggccaagaattttaatagacatctgctcttattatccttagttgaattaaaaaagtaaaatttctacctccaaatcagggactttaaaacaataatttattatttcactttgttctgtatattgattgggctcagctgtgcaattcctatttaagcttgggacctcttatgtggtttcagtcaaatgctggctggagcaacagtcaaattaaggctcaattgaactgaatttccaagattgctcactcacaagttggcactcaatgctggctattggcttaaaactcatctgtgcctttccacagttgtgcatgcctttccacagttgtgcatgacctggcctttctgtgtggcttaggcttctgtaacacagacctagtttcattcaccacattccaagagacccacctgaagctgcatagcttcttctgcacacagtgccacctccaccatactctgtgctgaagagagtacaccataatcaggtcgcagatgggggtggggacagtgggaagatgagatgaccaggaagtatgctcattggagcaccctcttaggaactagctaccacaagtttacctactggctacctaaaaatatatttcttcttttgacgtctcacagaaatcaacacagacatcaagctactgattgattaaacctctaataaatttgctgtctacaaggtatttttttctcattgttgcttgcttacaaagacattttcttttcagaccattttgccagtgaatcatcttgaatgtgaaatagtcattctgggattcccattgttcctttactcctctcccaggttatatactctcatgttataaacattttatcccctgtacagtcgaagacagctaatactggggaaggaaatgctatctagttgagaaatttcaaaacatacctaagcatcacatcaagtgattattgatgagttgctacatgctgtaatgtgcagaatgatttaccattgctatccagataaatatctaaccattaactatgtctcaggtgctagcaagcttattttttaaagcagagatataaaaactttaacaaaactagaactcatgctatagaactatatatggttctacctggaaacatctcaaaatagttgcctgggttttggatcaattgatgctgaactctcctttctcccacattactctgttcctcagttgctttggaaggtgatcaggcctctgttagatgtgtggttggtgaatatttttcccagtctgtgggctgctgctttgtctttatgacttgtcctttgccttacagaagcttctcagtttcaggaggtcacatttattaatttttgatctcagtgtcttgctactagtgtaatgtactggaagtggtcagtttcctgtaccaattcattcaagggtatttcccactttctcttctagtaggttctgtgtggttggatttatgttgaggtctttgatacatttggacttaagttttgtgcatggcattaggcatggaccttcctgcagtcttcttcatgccaccatccagttatgccagcatccagttatgccagcaccatttgttgaagatactttctttattccattgtataactttagcttctttgtcaaaaatcaggtattcataggtgtgtgcattaatatcaggcttttcaactcaattccattggtctacctgtctatttttgtgccaataccaagaaaaaaacttgttatttcttatcttaaaggtactcacatagttgcatcagcactggcttgctttgagcacgtgtttgatgcctatttctaaaattctgttctcaacatctttgtctactaaaatgataagcctagaataatgttgccctcactgtatctctttccatactatccaagttggccataggaacaagttttcccaactgtgactatcaacagagttctgacccgtagtcttgtgttcagctccctctgtatctgtcatgacctagcttcaaacttgtagataagtttgtgtgggcaatggtcatacactgcctctgttgctcaagattatatgcctccttgaatgtaatctgaggctgtgttaaagtggtttttgaagacttcatgttgggggtctatgcctcttcccacagtaaagacaataaattgcttctcaggttaggaggacttgccctcccattgctgcagtgagagaaacatgtacagctcttcccagagctgttgttcacagcttgttcaaataatcttgagaggagagataattgtgccttgccttttggtacttgtttccaatatatcaaactttcagcataacccattctgagttttgctgtggtataatgctgcagtcatagaaaggatttaatgtaaaaggatttttgatgactgaagttcatttatatcacacagctttatacagtattttttctggatttctctgccttttgattacttgtaatggcagggtttttgttgtttgtttttgttttcagtgcttcttcagtttaaggaaaagtcatgtagaatttaagtgaaatatgtcaaagagagttgagtatgatttagagataacaaaaattcatacttattaagtgatttgctggtcaacacctggaatcctagtatcctggaagtagaggtaggagatcagttcactgtggccttgtgtatctacataatcagttcgaggcccgtccagtccgagttccatgagactttgtttcaagaaatcaaaagaaaaagcaaacaaacaaaggttattctaatgaaaggcatcaacaaagaggaagagggcgtcatccagaagaaccagttttacacacagtccggagtggaaaagtcagcctactgcacttacagactgaggaataatcagcttgtttggacctgggatagtgtgggtaatgaaggggttagtgttccacacacccatgctaagcatttaaacttttcctgacattgggggtatggtggggggaactcataaggatttttccatttgggaagaaagaaaaagaagcttgtcagtgaatgaatgaatgcatctcttgagtgactcctgggaccaggagtttagaatgaaagatgggaaagaatatagtgatgaaaaacaaaatggtcaccaaaggtactttctcgccatttaattgatgaactgattgaatgggtaaggggcagttatccctttgaaagattttcatacattaatccaatgagtatataaaatgcacctgctcatgtcagtacaagtggaaaaacagacatatctgatattatggagttcatgtgtaaaaatgaatatgtatacctctataaatatgcatatttatgtagtgatatatatgtatcactttcctctgtatccctgtatttgaaaacaactgtattgtttacatattgatacaatcaatatttatttagtacctctgtgtattagggatcctgagaacttgtgacaggtacagaggcaggcaagatcaatcaaggagtatgatgtaggtcatgttaaaagttaaagagttgcatgctttggtcagggacaatgaaaatcattgtagagttttaattaagtattccatgtgatcatatttgactttttagaattattctggctgtagtgaaaagaatgaattgattggcaatactaaaatgagttttctgtgaataaaagcaaaacaacagatttcacttgcttacccattattatgatggataaatctcttcccattcaaggaaacattttatgcacaaacacaaataaacttatacaaatatacacgtgtatatactgtgtgcatgcacatgtgctatgaaagaagatctcaaacattcaaagttgcttgggctgaaagtattatatgcttgaaatttattatcaacaaatcattttggatttttgactgatttgcattatgactcatgaaaagatagcttatgaatatatttttcctactgtgtgctagactttgtaaagactatgatgtgaaaaggttgactgagtgaatttatcaaccagtataatgtttctgtgtctatggattggagtcttttctcctctgagtataatatcatgtttatccatgacatgtggttggtagaaaaagcccatttttttgtggaaataattaggcatacctttgttttcactgttaagtattttttcatttacattttatgcaagtggaatgttaaaacattttgtttgtataacattatacaaggaaatatcttaatacagctctgactgtattaaaaatgccttatgtgccatattgctcagatgacatgtttatgaatatgtttttaaagctccatatgcacaatatgcaatacaaagtcttcctccaaatactaagaatgcagctcattccatatttgctggtttagagtgctaacatttatctgcatctccacatcccaagatttgcaaatgagataattctgttgcagtatgtcgccaagtataaacagctggctgtctttggcgaggagaccatcatctgaacatttaatgcagcctttcctctaggatgccttttatcatcagaatttagggaggggcagtggcttggcatgcttcaactctgctgctctctaggagcttattctctgaaaatgataataagacaggacatgaaaggacagggtattaatattaagcattgcatctaaaatcttatgaacctaggagatggtcatttctgtgaaacactctgaaatttcaaataggccatttagtataatgacaatcacttttaaacagagtaagtttaatgagggaagttttgagccatggtatacatacaaatatagcaaaaaatgaaacagttttacccccatggggtaacacacaaatacaacaaccaaaaatttctctcagggttccaaaaatccaaattggaacattcttccccagaggaattttacatctctgttgaccaccattcatgctatcctcatgtagcacctaactcttgtcttaaagttttctttgtttctttgtttccccaaggtcaaggcaagtgctgatacatagaactatctgcaaaaaaatggaattgcctatgctggccaatattatatctaccagtctaacagtagttattgagtatacaaaatatggtgattgcaaatggaggaatgatttttaaatttaatatcaattctcagaaatatcttcccataggcatggtactcatgactagctggttggacatgaaagtataggtctaaaatgaggaacagcaatatggagctggtcctatagtcactttggaccttgaatcacaggaagcaggaaggctgagagatacttggcacacttcattgtcagttttgcctggatgggtgataagcaatctgagaagactccagagcaacaccagtcacttgaaagattccctcagaagtgctgctaacctatccgaggagcatattttagctgtccaaatgagcaataatcattacctttatggaaaccaaatgtttcacgggggaatgtatggttagaagcaggagatctacagcttctgtttcagtgtctctcgatgatatttaaggtttgtttgtgcaccataattatgaattatttaacctattacaaatacaataataatagctgtgagcttcctggattcatttcaatagtaaagggtaagtccatactgtaaaataatttttatttattatttccaagttttttttttccttcaaagaaagttaaggcagatgggatggtgtgttcattgcaacattcaggaagtgaggcagaaagattatatagttgagattagtctgggctacaaaacaggacctgtttttagaaatggataacaccaagaaaataagaactagtaagtgaataagcaacttaagtggaaaagatctatacaaaattgcacaataggaatacaaaagaaatggactaaagtcaaatataaaaataaaaacagttcatggtagataaggttcttaacaaatcataaaatatgcatgaaatatttattaataataaaattgctttccataaaagcaagtgttatctactgggtacaggtacaatatatgtctgaccctatggtggtttatatagagagtgtgccctttagtaaacctatgtactggatatgattatcttcagtttgcaaataagggttcttgttttaaagattggaaatgatgttcctcaatttatggcaccaaacaataaagtgaccagaatatgactcacgatttgcaaaaatccattttttttatctaattaaatggaaagtccagaaaatagaattgatttttttccattcatttatttagctcataaataaagtcatgcacaattatgatacagaatacagtatgttcacaatggcatcgctaaattaaaccaattaacatgttatagcacacatattcatcatttttgttttgagaacagttatatttatatatgtatacaatagcaattaatgaaaaaaaagattctggtttccgaatgggaataaaaaaaggaaaaaagaacatgaatttatttgaaagagagtaagaaggattgtctgggaagtttcagaaggacaatagggaagggatactttatatccttaaaccaattgtttccccattgttaaaagacccacactgaagcttaatagccacaattctgcgctctctgttcccataagttcatcatttctagtttacagataaaattgagattgtgtgacatttgccttccagtgtgtcacttatttttgttttttggcaagcatataacttcactacttactaaagatgaaatcaaatttgcatgcacggtgagcactcactgaaacaccttggattcatcacatatttgagtttcaaacaaaaagaacaaaaacaaaaaacaaacaaacaagaaaaaagtaaaaaacaaaatcccagaaaacagcacagttctgttactcttgtggtacttagcaccgtttttttttaattagcttctcagtcatcatctgggaggaaaccattctgagcaacatcattaaaaacaactctgacaaagcatggtcacaactatgtatcataaagcaggtccacatatgagtgagnnnnnnnnnnnnnnnnnnnnnnnnnnnnnnnnnnnnnnnnnnnnnnnnnnnnnnnnnnnnnnnnnnnnnnnnnnccattttcctgccatccattttcctgaaaatttcaagattccattgttttttttctgctaagtagtactccattgtgtaaatatactacaatttctctatccattctttggctgaggagcatctaggctgcttccagtttttggctattacaaataatgctgctatgaatatggttgaacatatgtccttgttatatgaatgtgcatcatttgggtacattcctaggagtggaattgctggatcttgtggtagactcattcccattttcttgagaagttgccatactgatttccacagtggctgtactagttggtactcccaccaacagtggaggagtgttcctcattctggtatcttctttaatttctttctttagagactcactattcttacggtacaggtttttcacttttttggctagtgttactccaaggtattttaagttgtttgtggcaattgtaaagggttatgcttctctgatttctttctccaccaatgtgtcatcggtgcatagtatggctacagattttttttgagttaatcttgtatcctgccactttgctgaaggaatttatcagctgtaggagttccctggttgagtttttcgggtcacttatgtagactatcatatcatctgcaaatagtgagagtttgtcttcttcctttccgatttgtattcccttgatctactattgttgtcttattgctctagctaaaacttcaaggacaatattgaagaggtatggagagaatggacagccttgtcttgtacctgactttagaggaattgcattgagtttctctcctttttatttgatgttggctgttggcttgctgtatattgcttttattatgatgaggtatgttcctgttatccctgatttctccaggaccttcatcatgaagggatgtggattttgtcaaaggctttttcggcatctagtgagatgatcatgtgattttttttccctcagtctgtttatatggtggattacattgatggattttcgtatgttgaaccatccttgcatcccttggatgaagcctacttgatcaggatgaatgatttctctgatgtgttcttggatttgccaatattttattgagaatttttgcgtcaatgttcatgagggatattggtctgtagggatattagtctgtagttctctttcttagttgtgtctgtgtgtggcttgggcatcagggttattgtggcctcataaagagtttggtaatgtcccttctgcttctattgtgtggaatactttgtggagagttgctattagctgtacttggaatttctggtagaattctgtactgaagccatctggccctggacttttttgggttgggagtcttctaaggactgcttcaatttcattagaggttataggtctattttagttgcttatttgttcttgatttaattttggaaagtgaaatctgtccagaaaattgtccatttcctttagattttcaaatttggaggaatataggtttcaaagtatgacctgatgattctctgaatttcctctttgtctgttgttatgtccaccttttcattcctgattttattaatttgcatgttcactctttgttgtttggtaggattggataaaggtttgtctaccttgttgattttcttgaagaaccaactttttgttatattgattctttgtattgttctcctagtttccattttattgatttcagccctccatttgattatttcctggcatcctcttctccagggtgtattggcttctttgttttctaaacctttcagttgtgctgttaattctctagtgtgattattctcctgtttcttcatgtggggatttagagctatgaactttcctcttagcactgctttcaaagtatcccataggtttggatatgttgtgtccgaattctcattgaattctaggaaatctttcttttttatttcttcctagacccatgaattgtgcaattgggtgttatttaatttccatgagtttgtaggttttctgtagttcttgttgttgttgaattctaattttaaagcatggtggtctcataagacacagggggttctttcaatttttttgtacttgttgaggtttactatgttgccaagtatgtggtcgattttagagaaggttccatgtggcgctgagaagaaggtaaattgttttgtatttgggtggaatgtatagatatctgttaagtccaattgcaccataacttttattagttcttttctttcttaagtttctgtctggtgttcctgtccattggtggagtggggtgttgaaatctcccactataagtgtgtgtggttttatgtttgaattgaattttagtaaagtttcttttacaaatgtggatgcctttgtatttggggcataaatgttcagaattgagacttcatcttgatggatttctcctgtgatgagtaggaaatgaccttcttcatctcttttaactgattttagtttaaaatccaatttgttgtatattaggattgctacccccccccaccgcttgtttcttgggtccatttgattggaagatctttccccaaactttnnnnnnnnnnnnnnnnnnnnnnnnnnnnnnnnnnnnnnnnnnnnnnnnnnnnnnnnnnnnnnnnnnnnnnnnnnnnnnntcattctgctaatctgtgtctttttataggggagataagaccattaatgttgatggatattaatggccattgattattgttcattcttgtttgtttatgatttagtgatggtggcaagattatgtgtgagattctatcccttttttcttttgattgtttgtaagttgggattatctattgcctatgtttttctggttgtagttaacctccctgggttgcagtttacttaacagtactttctgtagggctggattggtggatatgtattgtttgaatctggttttattatggaatatcttgttttctccatctatagtgattgaaagctttgcttggtatagtagtctggactggcatccatggtctcttagtgtaggtagaatatcgatccaggaccttctggcttcagagtttccaaggaaaatttaggtgtgattctgataggtttgcctttataggttatatgacctttttcctttgctgctcttaatattttctctttgttgtgtatgcttggtgttttgattattatgtggcgaggtgacttttttttttacgtccaatatatttggtgttctgtaggcttcttgtattttcatgggcatgtcttcctttaggttgggaagattttcttctatgattttgttgaatatgttttctgtgcctttgagtttgatttcttcaccttcttctatacctattattcttaggtttggtcttttcacagtatcccatatttcctggttattttgtgttagggatttgttggacttaagattttctttggttgatgaatctatatctgctagtgtgtctttaactcctgagattctctcttccatctcttgtattctgttggttatgcttacatttgtagtacctgatcatttacccagcttttctatttctagcatttccccagattgtgctttctttattgtctctatttcagtttttaggtcttgaactgtttcttgtatttttttagtttgtttttttcttcaatttctttaagggatttttctcatgtcctctttgaggtcctctatcattttcatgaagatgtttttaaggtcattctcttctggttcatctgcatcgtgaatttgaggtcttactggtgtatgtttcctagtctccggtggtgtcatattgggttttctgttgttggatgtgcttttaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctggtagatgcaaacagttccaatactctgatgtcggtcctcttctcgtggatggcggtgtcactgttacctgggtttttgcaatgtctgggtgtactgtgtcccactgggatgggcaattggaagcagagctgtcactgtgcctcagggtgtcgcatcctgctgctgaactctgtatggttacttgtgtcagatgactctgagcagtgacgacaagcaggagccagaaacagcctctggcctacctgggctggtggatggaggccgggctgcctctgggtatttggtgtttggaacccaccaccaccaccaaactgggtctggcaggcaggtggcttgcatcagatgactctgagcagcaatgacctagaattgattttcatatgggttcatataaagcataaatgtatcctgtacacaatgattttagtcaaggagacagacatcaggaaatctgaattcctcatctggtaagcacatgcacatctccaggcaccataaacctagaatatgtgatactaattttctgtataatttaaatataacacatcaaatctatgacaacaaatcaattatattcctgctcttgtgatcctagaaaaatctgaaagagtaaagcatactggatggtcttgtcatttaggctctggatttgcctcagtaagctggagggacccttctacgcgcgcgtgtgtgtgtgtgtgtgtgtgtgtgtgtgtgtgtgtgactgcatcttggaaatcaatgcagagctactgaagaaacacttcctctattccttttgacaagaagtcactaccacatcttcgagcaagagttgcagaagctttgtgaagagtgcaaggccagtatttacttttggtactgaaagtgagtcctaaagtgatggaaaatttcttttgctgataaagtgtatgcttcattgtgaacatagtcagtttgaaaaatacagaactgagcccaggacatgacttgagttgtggatgttttttccattcttcaccattttggtaatttgatttgatggttaacactctcctaacatagttatggggttgggctcttgtctctctttaactatattctagtgagaggtcccttctggctgttcatgatttggaggggttatcattatttagtttagacaatatttgcttaaaatcaggcttaaggaaaagaatataggatcaacattttattgtatttttgactgaactgataaggtctccttctacaaattttcctgtctgacaaaggaaggcaaatggcattgtgtcactgaacattgctctccatttaagttcggtttacctgaattacaatttcactcagtttcgatttgctgcctatttctgaatcaaggacatatatttcttaatatttatgactatgtgtttacctgtataaatcagggtactaaactatctttaaagtaaagttcaaatgaaacacagaaatcaaaagtaaactgaaaataaaggagttctttttataacttagtgagaagagagcagtaccagagttgcaaagattaatgcttagccttagggcctattatggttagtgcaggtaactaggcagactcacaatcccctaggagacaggttttatgatggttaatgtagttaaccagatagacccataatcccctaggacagtacatgtccctgggagtaggaacatcccatgggcaagggatcctgggctgtacaaagtgaggaaaagaagctgagtctgagattgcattcactgctctgttccctgtcagaggcaccatgtgatcagctgcttccgtctcctgcttcttctactttcctgtcttgaagtgtaaccagcataaacttgtcctaccttcagctgctttttgtggggttattttattgtagcaacagagaaagaaaccaagataggacttttattgtgaaattttgttttctagtttttcttagcagcaagcctgtgaaatgctggtgtataacttctccagttctggaaacattcactgttgatatcgaaagagggataagttaacaccatgctgatttatttcaacagttgagagatcacaaaattgaattttgtgaaaaaaataaactcaaaccctgctttatccagattattatacaatgtataattttgttggtagaagatgtcattagtgattttatccatgatctttatctaaaggattagtgaggggaaggctactaacatctgtaggtttacatcaatatttatttttcttcttgtgagtttaatacatttgcaaaatagaagaataatcagatcaatgtcacacataaagatattcacagaggatctttagcattcacagtggaaacatgggaattctcaaaggctgctaaagcaattggaaaagcttccaatctgcgtctctataccaacagggtgagctgaaggacagcatggtgtaaaatagggagtcatcatttagcagatgcatgtggtactgtctgaaggtgactgccattcctgcacctttattttccaccctgcaaacatgataggcaggaagttggccattgagctacattcccagaatttctctaaagtattggcggcagagaacctcggctaggaagagaagaagtgcactggctctcatgttgcagagactgtgtaaatgaattaaataagggcatgcaaggttgcatatagattttgacagagaagaaaatacataacattaactagtaagctgtttgtctgtttctctattaagtggaagcctcccagtggatgcctgaatgcctgaattatgcatctgactctcttatttcaacctctctctctctctctctctctctctctctctctctttttctctctctctctctctctctctctctgtgtgtgtgtgtgtgtgtgtgtgtctcctttaaaatccaggtaagatagtctagcaactgaggtaagcatttcgaaactcctgttgtgtattctcaggagacataagattatttgagtgaactagagagctcatgtgtcctctaagctcaagacagcatttggccatgttggaatttctaagtgatgactccttatgagggatttgattcatctgctttgaaataataatctatgaaaactgtgtgctggctaaatggaagctacattgatgggcaatatgctcatcatataagcatgagtacctgagttcaaatcctaagcactaacataaaagatatgtgtggccaaaatgcatctttgacatcagcatttcagagtgacaggtgcatctcagtcatgtatggccacatgaatctttgattgcagaaatttggggggctttccaaagatcttagttgaatcagtgagagaccttatctaaaaaaataaggtgaaaaggcatcaagaataacatttgatgctaaactctgacactcacatgcatgtatgtatatggagacacaacttgtgcacatgcatacactatgtacatgcaaagtacacagtcatgttattttcatgctaatgcagtgtgtgtgtgtgtgtgtgtgtgtgtgtgtgtgtgtgtagtttcttctcacctttgtgccacatttcttaaggatgtacttcaaattttattttccctttctccttttaatgacctaatttttgctttcttccctccatgatatgggatcattctggttatcctttcattgtcctctactggaccagaaattctgtacttgatgagcattacttcaatgctattctgtcaattactttcaaggacttcagtattgatgatctgatttaacctgaatatgcattagaacaaggatgacagggaggcaaagacaagaacatgttcaaactattcaaaacacttgtgcatttcttctagaaggtcagagtacacattgtaggctattttgaatttaggatttgatcctttttgttttaacctattttgtttgtttgttttcttaggtcatatacttttaagttctgtacataagcagtttatcatggaagcattttttttcatagatggcacagtctaaatgaagagtggattcctgtgagtctttaaaaagccgaagatgagttcaggatatctctagtaagtgtgatgagatttaattcttttgttattattttagaaacaatcttattttacatatcaatcccccatttcctttacctcacatcctcccacgccctccaccaacccccaactcacccccacccactccccaaggatagtgaggtattccttgggggattattaaagtctgtcatatcatttgggggagggcctaggcccttctccctatatctgggctgcaatagtatccctccacagagaatgggctcccaaagtccatttttgccctagggataaacactgcctgcattattagagttactgtagactgttctggtctcctagctggcacccacattcagagggcttggctcggtccaatgctggtttcccagctttacaactagggtctctgtgctctcactaggtcaggccaactgtttctgtgggtttctcctgcatggtcttggctcttttgctcatccctcctccctctctacaactggattccaggagtatggctcagtgcttagctgtgcgtgcctgcttctgctttcatcagctactgcatgaagactctaggatggtaattatagggagagagcatcaaaggcagcctctccattactgcctaaattcttagttggggtcatccttgtggatctctgaacatttccccagtgccagatttctctttaaacctatactggctccctctattaaggtatctcttttgttgctctcctctattcttcctctgtctcagactttctgatccctcttgccacaatccacaccatcagagaatgcaggaaacaaggaggacactaagagaggaaaatatggttcccaaaagaaggggaaaggggcaagaagcccagagcaaagcaggagcatggtggcagaagggagggaggtaggaaaacgagaagaaaagaagagagcagagtagaacaagagatttgattctatgtcagaacattgtattaataaaataaatttctatatgttcatgtaatgtaaagattgcttagatactacaaatgaaaatcattggctttttgttttcaaatatgctaagttttgcacattttatacctcttttttaatgtaaattctttagttactactcacatttatatctatccccccattccatagccctcccatcctcccatgttccccaccaacgcccccatcccatcccccaactcctccctagggatagtgacgccctccaccaggggccttcaaagtctgtcccaaagtttgtgggagggcctaggtactccttgctgtatcagggctgcaatagtatccctccatagggaatgggctcccaaagtccatttgtgctctagggttaaagactggctccacggttggaggtcccatagactgtcttggcctcctagtgcttcttgagagcagagtcctagaattagccaatgttgtgtctttcatacccaggagagtatgtagatggtaaatgaatacatttacagagctgaactaacttttctgtattctcaaacttaatgtatgtctatccttttgtgatctcccccaaatttctctagtacagaatctagaatgcatctttgatgtttagaaatacccacatggctactaaagaaagtcaaataaatgagtctctgatgagatatgacagtgacatcatgctggtgtgaatggggcacagcaggccaacaatgaaagcctgcatatatttgtggttggaaatacaggtaatagatagggatgtctttgggaaggaggtgatgctggaaattagatttaaaaggtgaccatgtttacttatatatcaaggggtctgtcattgtgagaagagtaaatataatatctgagacagctcaaaaggagccatataggaaaaataaaagaatactcatgtattttactcacaaaattcaatacctgcatatgtatggggatttctcccacaccaactaattctttaataagttcgctataacttattttaattacaatactatctacttggagttagaaaaacataataaaacccccacaaatacatgtttagtgtcactagcctggcctccatttcaaatggcagatacaaatacacattgttaactgtgtttttttacttagatccccacaatcattgattagattaatttgctaggatgacagctaggcttgaagagatatttaaatattcaccagtttagtgtttactcacaaagatcccaaggaaaggcacttctgcaagtaccctaagcagaagaacttctctccatgtgtttgtggagctttagtcacttagcatttacatgtctccctacttctccatcttcatttgccagggatttttatagagctgccatcacaaggtagtgattgcttagtaactcattctgcagttccttttccatttcaagggctgggtgttgggaataaaaggcccaaagttgaagtcttggtccattctttctggagaattagccccattctagatctatccaggttaaaataaccacattagaaagatgtcccttacttagacttcaaggttctgtttcaggaattctgggaccaattttaaaaattatgtcataataacacagggaatgacatgcaaagcaactttcaagacctgttattactgttctctgactgaattttagggaatcaagacagttacactgagatacaattctgagaagtaggtgtacaccagactaacactcttcctacctgctctagcaaacaaaattcaacatcatcattaatacattctttatatcttctatctttaactgagttaatgaattagactataacatcctttgtgacattttccacccctttaattttatcatcactgttactcttattctagatattaactttcttgttcaggaagcatttcatagtgacttttagtcatcaaatactattctaggatacaggaatacagtagggaagagataaataaacaaaggtctccattaagtctaccatagtagggaggtaattaatatataatttatagttaacaatttcatgaagtgatataatggagaaaaaagtaaagaaatatttaatgaagtaatagcatgttatggggtatatctcattaggtatggtggtctgtgttttggcacaactctctctagatcaaaacattctataatgaagggaagctccttaagactcagagagtaaataacagaaaagtcttacagaagttcctgaaacttgttagattcataatgaatcttcttaaggttatatatgaagtaaggactgctagagaagagggatttttcgcatgtcacccttactgaaagtcatgcagagagctccagggatgtagcttttgtaagtcatcacctatgcatagatgtcttttagtcaacttctctaaagctaaccaacccctcacccatattcctgtaaaccaataagcaacgctaataacttattcattctccaagtttcttttgggtggcagtgttactattgtctgtcattgcttcattctttggagtaaatatatgttttttatgtctcctcaagaaaaattacagcagtctgataacttgccaaggacataatagtttagtagagaattgtttgaattcacaaagaaccatgagagggctgagaagttcttccaggagagataactacttaggaataggtcaggaataggaattttcaggatgaatgcaagtactagatttgcctaatgtgaaataaattgcttatgtaaaattttgcattactgtgataaaaatatttgatagacaactcattgaaggaaatatttattttgatttacaacttgatagttcttaatcaaagagtgcatgagcccagctatgtggcctgaacattgttatggtagaagtgtgtgagacaggacagctcttcatagcagacaagaaacatacacacgcacacagacacacaaacacacagatatacagacatacacagacacaagagagaaatagacagagacagagacacagaggcagagagacagggagagagccagagagaaacagagagaaggtgaacacaccaggagaaagagcatacacatgcttggtgccatccaaagaccacccttcctgatatatttcaacctgctagacctgacttttcaaagggtcaacagcatcccgcattagcacctctagctggggaacaagtgttctaaccacacttatatgaaaatgaacacactgttttggctttacatattccaatattgatagatatgtgtttggataactggagaaaactctggaagaaaatattttatatttttgcctctcacttcctatcctggaaagaaaacactgattttcattagcaagtcctatggctattttctgatgtagactaagcatttttagactgtcaaacttaaagttcatattaaagtacaagatttggattaaattactcaactccaccccacagagaaccttccagtactactataattatcattaaattaatacatcccgtggaatttcttgtgatggtatcaaactgagaaagtatttttccagcttgactctatctgaaatgtgctgaaccatcatataacatgctataatatacaatgtattttaacatgtatttaatatactataatgctataatgtataatttgggacacacttgtctatatataatacctgagtcatctgtggaattgaagcacctttatctatgttgtaataagtattcattatttggataattaaaggtttataaaagccctataatttaaatgtgtctgtgttattttataactattgattaatttaaggaaaaacatacattgtttaccctagactatccttgcctttctaaatcatggctgtaagatttgactggcatccataaatatttttaaaaagacatttttcaagatggaatttgtcatggttaggaacatttccttcttaagattcagcaacccatattgcaaacgacacagtatttcttaagcactttacctcctcaacattgttaaaatgtaaataaaataaataaaatggaatttgaatccacagggtgtctctaatagcttcttctccctgacagggagctaatatgagctccatctaaccaactgatttttataaaactgaaaacactggccgctagttatccacactgttgccatagctcttatgtcattttaattccagaggcagtgggcaataccagtacctatgaattacatattttaaagagaatttataaataatgaatgaactgggagagttattggcattgaaaggaatatatttcatgatgaatattaatgaggataaaagaccatagggatgtgcattgtaaaaattagtgattaaaagtttaaaagtagaatagtttctctaaaaatttttattgcttatttattttgtgtgtgtgtgtgtgtgtgtgtgtgtgtgtgtgtgtccatgtagcaatgtgtgtgtagaagttagaacacaactttcagaggttatttttctcctatcaagctggtcctctgtatcaatgtagcaatgtgtgtgtagaagttagaacacaactttcagaggttatttttctcctatcaagctggtcctctgtatcaaactcagattgtcccacttagtggtaggcacctttatccactgagtcatttgccaactccaaggacaacttcttagagtcatggataaaaggtccagcttgagacccaggccatgagaagaagtccacccttgatactgcctggaagaccaggaacctgaggttgggtagcccttaggcctagtatagaacaaaacacaaatggcaaaaacaaactctcccccaaaaagaaacaaaaaaaaaaccctcaacaaaatgattcctaattataatctgctacacttgtagaccagagtttagcataatcatcattatcagagaggcttcattcatcaactgatgggagtggatgctgagacccacagccataacattaggtggaccttgggaaatctcaaagaagaagggaaggaaggattctaggaatcagaggggtaaaggacaccacaagaaaacacattgattgaatcaactcaccagagctcatagaggctcacagagactgaaccaaaaattagagagtctgtatgggtctgacctaggtcctctgcatatatgttatggttgtgcagcttgatcttgttggactcctaacagagagagcaggggctatccctgactccattatctgcttttgggacccttttcctcctactaggttgccttatctagccttaatatgaggggaggtacctattctcattgcaacttgatatgccatgtttagttgatatccttgggaagcctgacctttctgaagtagaaagagtggatgtgggtataggggcagggacttggaggagaagagctaggagaaactgaggtttggatgtaatgtatgagagaataataaatttataaaaagaaaaagaatgaatgttgagagcaatgtcaaatagttcagttatagatcatgtctgtaataataaaaacatggattagaacttactagtgaataatttttattattactatttcatttggaaaaaatccaatcacaatattaaccaaaagatagtcaaataagagtcagcatgtattgtgagagtgtcgtatttcttgtttggttttatatgattgttgaaggcaagattatatgacaatattaaatgtaataaagtgtaattcagaatttaatcctaagtactaaagtcagtcataagacaatagagagataatttcatccaacatttgagagatgacatctcaaattattaccatttgactatttgtattagttatgtgggtatattgaaggtggctaggtgtctgtctcctgggattagtgttttacctccgacactgatgtaacctcaaagaagaatgtgttctcttaaatagctacataaaatgggatcatgctcacaaatccacaagaaactaataaaccagcatatgaatctctagtcatgaatgacagtgtaatgagaaatgaaagagaaatacagagaagactggatgcctgcacagcctgacaagcatactgtgttcccaggaggaatgtcatttattatttattcatcaaatgtgtattgatgtctgatttataccagacattttgccagacagtgggatgaaaaatcaaatagggcatagtctctgccatcacagagcttatcggctagtgagaaagacagccaagtaaaaataacaattacagcagtgtgaaggaaagagggttccaaacctgagcaggcatctggaaaggtttccctgagaggtgaagggagatgaagcagagagtaataaatggttagctatctgaggagaggagcaaggcattctggtctagcagagcagtctgacactcagccagggtgagagtaccaagtgctaaggtggtggaggctgtgtgaggggatgtcctcctcatggtagctgaccatattcctggacactggatctgtctggtcattttacggctcattttactacatacttagattcaatcatccagtcatataatagagtctttgcatacctattatgtttcagatactcacaggacactgtgtgttgaaagtgaacaatgcaaaatgcctgccacacagaatttagaagggttggataatgtcttctctcaatccagttccttgtcactgactcaaactttgtgttgtttctggggcccatttcttgtgccttgtctctcattcttttcatagctatagtaaatccctttgccccactcctcctaatgatgtgacaaccatcttcaggtgccagaatccaccatcttaccttatataaagtcttatcaggaggaagacataacttttttcagtttctagctttaaagatgagctattccattcttcattggttcctctcctgttttttgtttttatttttgtttttgtttttgtttttgtcaattctgagtgtttgttacctcagctcattcttgccttcatctatctagcttaaaatttcctatctctcatgtttctcaggtgtgtatgtgcctcatttatagaaccatccatttagagatacagtaaacacttgaagaggaagaatgacaagattagactgacgttttcaaaaggattatttggcaatctccaaagctgtttagttaatatgtgcatatgattagatagagctgaataagtttccacagtttaattacaagttgggacatagtacccaagagtctgggatgttttatttttaacgatatatttattctttgaaagccatatgcatttatacaatgtgtattgctcatgtacaactacctcccttagacacctaggttacagaagccatgactctattatggcaattagcatagcttctggtctgaaacagctcacgattcactaaaggacatggcttaattttacccagtgtcttagcaatctcttattttctaagaaacaaagtagagttatatgtacaactcaggtgagatttaacaaaatctgtgacacgatggttgtttgctattcctgaatctttttaagacctgagtacttcctttgtgatagctctttccttccatggtcatcacacaaaaattatttgtttcaggtaatttattcttacctagagcagctaattagcctctctttcctacttctgtcttgctttttaaattgctgggagggggtggaagagaactcaggttcaacaggcctgcagaccagagttatgacaagcaaggactgaagctataattacagaggcactgtgtggagcctggtgagagggctgtcctcactgtgaaaccttctgttttgtcaatattcttacatcagtgcttggcagtcacttctgctgcttcagggtttctgcatataaaacagacaaagtcactaatatcaactcagcactacattacatttacagtgacaaatcctagtttagaaatgcacccaccggagctgaagctggaggttcacatcaaactcttaacatttacatttttttcctctggtgggnnnnnnnnnnnnnnnnnnnnnnnnnnatttacctgttgttgatttcctgaatctccttaaatccttgcaaccaaagatggtccttccatcagagaagcaattaaccaaattcctgactgcagcatatgagctatctgttataaaagcataaaaggttaaccaaaaacccagagtacaaaggcgatgtcagaccagaacaaatagacatggagaattacctggagggaatacagggagcatatgtacagttaagaggatgttatgatgagaagggtttgttgttctgactgcaaagactagaaggatagaaattacatgtttattatgaatcaatataactcatattctgcagatttacctgacccccaccccctgcaagtgcagctctttgtttccagatgcaagtccaaatccaaagtagttgtagaggcctcattcaactttcatctagaacacatgcttggttttttttttttttcagacaagaaaagcattttttaaaatactttgcattgcctgagttaggccaattagttaagcagataaaaaaaatggttgctttgtcttacagagttatcttttaatcatttattacagatgagaataaaattaatgagaatgatctttgttacttaatttttgtcccccagtaaacaaattactaatcaaagagagttaaaggagcaagggtttattttgtcttatggttcaaaaggatgcagtttcttgtgacagaaaagtcatggtggtaggagcaggcaggtcacatcacatcacatcacgacacacagtgattattgctggtgccttttcagtccaagataattcccccagacttgaggttaccaacctgtaaggtgggcctttgaacctcaattaaccttatgtagaaaatctcagacatgcctacacgtttgtttccatggtgattctagatcccatcatgttgacaattaagattaactatcaaagtgaaaatagccttgcttttaaaataataggtacttgcccccatctcctactgagaccttactgagtcactatagtctatatttcttccagcctgccatagtgcttaggtacaagatgctgatcacaccaacctggaccacaagcctattagccgtactggcctcttgaatttgtaaagcctgttaatctgcaatttttcccattagttgatttttctccctttccttttcctgactttgtaatttcttaatgtggtcactgatggaaactgaagatttttcaggtcttggatccttgagtttgagagaaaacctgggaggaaaatcaggaattgatatagaaaacactctaaactctggtgtgatgctattagtacactgtatggctgatgttcctctaaaacatttgagaaggatgagaggtcttggataggggtgaggacctggtgatatttggcatgtatgccttccattttccatatttgaaatctctatttagtggtaggagtccataaaatgaaactgatttttaatattcattttaatagctaaaaggaattaacagatatcataaagcacttaatttgaagtaaggtctgtacgttgtgtaccttgactaggtacatcgcttctgttttacagaaggaactgaggcactgggatttcatttgaaggttaattggaagagggaggacttggttccaggaatttaagtaacctctcacttgctttacagaaatggtttgctttaatataattttgcatagcattgaaaaattgtaagacttggttgaggaactgtgttgtattattttcaagtctctctttttcattactgtagaattaaatagccttgcttttttatatgtgaatttttagtagcttccagcagagggactgctctatgtatttctctctgccattaatgtgaatttcgaccacattgaattcaaaggggaagttagagtgttaaaagaagtcttaaaaagcattaaacattttcatttgttatatttatttactttatgttattgcaatgagatttgctggataaatgctggttttagacttatgctgatatgtggcagaccttaactgaaccttgagcttggatccacgcctacataatatttagcctgaaacagaggtgcccatagtcattgaccctagatcagctacaatcagaggacccaaagagtgagaaacaaaataaataatcaatggttgcctttatatgacactggtgttaagaatcttttatcttgaaacattattgtaacaatgcttggaaatatcttcaaaattatataacaatatcagaagtgtctaaaagagctatacagtcttaacataactccattgttcctctgaaaagcaagcttcagaattatataaaatattaatattaaggaaaattaaaggtataagtcctgtaacatttatcatctaaataaagaagtttcagaaaaatatgttttttctttgtcaaatattatgaatgataaatatgtcaaaatctgttattcagaattttgaaaggccataaaaatatgatggagatcattaaaattattgaaaaatccctgttgtaacccagcactttgcaagcattcagtaatgttcatcaattttctttagaagatatatgtccatactgttccaaagactttaatttgtttgtaagttttcattgatatagcagttgttggatatttagaacatcaaattttttagagattataatagaatcacaacattttctccttcccctttctccctccaaatccccctataaacccttccccactctgcttcaaattcatggtctcttttcttcatcaatggttattgcatgcatgtatgtatttttatatacttaatgtatttccatgcaatgttttctgaaggtatgttttctgggctgattgtttatgaattggaaaaccaattggtgtgctcttccttggagttctcctcctttcctgttctcagctttacaaagtttcctgtagtttttgtgtaggattgaggcctcttgacattcccacatccagtctggcatatgcctttcttgttcagtccacctatgggcagtcacacttataagactttatagatgtagcttctgacattactagaagacagaaactcctagcaaagtccctgatcttctgcctcttatggtctttctgtctcctcttcatcaatgttccctgagctttaggtacaggactcttttatagatgtattcattgaagacatcatgtacttcagaaacagggtccaaggaccctggagattgaactgactttaatgccttctccctttggacatgtagaaggggttctcaccagaaggttccatgcaagtttccaaaggaaggaggcaacaaacagtgctactcattcatgacacctatgaaccatatcaacaagcatgatataataaccatacagttgcagtagtggcacatataccttagtagttagcaatagcactctagttgaacttaacacctactcacaagaagaaaatcaagcctggtactgggaatttagctaactacccagtgcttgtgaagtcatgattattgggggagaatctacaacaattattttattagagtagcataccaagaatttatattttttttccttatcctacagataagtgtagtctttacccctcatcaaggaaatttctgtttgcaacatactacgaacatactacagacaaccacaaccattaaaatgcagagttatgggacatcggtttttaatatgaagagaagtgggactaattccttccttggaacagttaactgggtttttcaaaagaaggagagatgtgtgtcagccccccaagatctcagataattgataagtatctaaaggtaaattcaacagggcaagaagaagatcaatggctgattaggacactgtatagaacttattcaaacatttcgtgttaccacatgaactgtttcatggtgaaatatcttatctcaatgacttcctgctactgaggtcattgtatccgttttgtaaaaggaaaaaatttaggacagatgcctgaaattttccattcatcttgtctttttctttttttccctctctgaatggaagattggggtgggggtgattttgtagatccagtggcttatgcattttgaagattctccctaagaagataagcatacatttattagtgtcaattagttgtgggaggtctacttgaaaaaagaaaaagagttacagctaagtactactgcctaggaacttctgctttggagtgtcataaatggacacatcatagcattgtcttgtgctgtctgtattcttctagaagacctcaaaagacaagcaaattctcactaacctgagtctgttcttgaaaggacactagcttcatgaaagcttctgggttcgttaatctcattttttctcttatttctttaagttatatttatttttaaatttaaactgtttaattttcacttgtcctacttcattctgaaaatttgtcttagatttgttaagtataatatgataaccaatgctgtctcaaaagatagagttaacacatcctctttccaagcaatttacagtacaaagaaatctgccttggaatatttaaaagcatagtgtagtgtaagttttgtaaattgacacatggcatagatattaaaataaggaaattacaaaattatatacctggcaggaaacttcacagatgtaaaatttgaatgaattatgaaaggtggggaaatttttgattagtagacaaaaaagaggatatcattatagtaaagctatgacacaaatataagaatggcaaagcatggaagcagtactaaaaagtcagcatgagcatggtggaggatgaggagtcatgaatgtgtggatcgaaagctacaaagctgctctaagaaatctgcccatgttaagggagccaagaatgtagtccagtctcctaaacaacttttatgtgattgtatgataatgtggaaagaaagtacttcaagaagaaagttgaacagatgtccttgttgtatgaatgtgcattctttaggtatatgcctaagagtggaattgttggatcttgagatagactgattctcattttcctgaggaaccaccatactgatttccaaagtggccatacaagtttgcactcccatcaccagtggaggagtgttcccccttttccacatccacttaagcataaactgcctttcatgtttttgattttagccattctgacaggagcgagatggtatctcagagttgtttagagttgcatattcctgatggctaaggatgtcgagcactttgagtgtctttcagctactttagattcctctattgagaattgtctatttagttctgtactccactttttaattggattatttggtatttcagtgactagcttcttgagttctttgtatattttggaaatcaaccctctgttagatgtggggttgatgaatatcttttccccttttgtgggctgccattttgtcttgttgactgtgttctttatcttacagaagtttgtcagtttcaggaggtcccatttattaatagttgatcttagtgtctgtgctactggtgttatgttcaggaagcagcctcctgtaccaatttgtttaagggtacttcctactttctcttctaagaggttcagtgtggctgcatttatgttgaggcctttcatttatttggacttaagttttatgcatggcgatagacatggatctatatgcagtcttctacatgccaccatccacttatgccaggaccatttgttgaagatgctttcttttttccattggataattttagcttctttatcaaaaatcaggtgttcataggtgtggtttaatatcagggttttcaattcaattccttatatctacctgtttattttcgtatcaataccaagttgttttcagtactattgctctataacacagcttgtagtgaggaatggtgatgcctccagaagttccattattttacagggttgttttggctatcctgctttttttttgtttttccttataatgttgagtatttgtctttcaaggtctgtgaagaattgtgctggtattttgatagggattgcattaaatctgcagattgcttttggcaagattcccattttttctatgttgatcctagctatccaagagcatgagagatctttccattttctgaaatcttctttaatttctttctttaaagactgaatgctcttgttatacatgtttttcacttttttggttagagttaccccaagatattttatgttgtttgtggctattgtaaagggtgaggtttctctgatttctttcttagccaatttatcatttgcatataatagggttactgttttttttgagttaatcttatatcctgcaactttgctgaaggtgtttatcagctgtaagtgttcccaggtagacctttttgggtcactttcacatggtgaaagtttgatttcttcctttccaatttgtatccctctgctctccttttgttgtcttaatgctctaactagcacttcaagtacaatactgaagagatatggagatagtggacagtcttgtcttgtccctgaatttagagaaaatgcattgtgcttctctccatttaatattatattgtctattggtttgctgtatactgtttttattatgtttagataggttcttgttatctctgatctctccaagacctttatcatgaaggggtgttggattttgtcaaaggctttttcggcatctagtgagatgaacatgtggcttttctttttcagtttgtttacatggtggattacattgatgtgttttcttatgttgaaccatccctgcatccctggaatgaagccaacttgatcatggtgtgtagggagtcaccctagccccgcccaatagtcctggggcaggtaccaggtggacccggggactcgcccagaagggcgtggtgaaggaaagccggggtgacgtaagggagcttcttaaggggctgcacatggtgaggctggccccttttgttctggccgcgctggctgggttctataacctagctctggcctgtgttttaccttggtgtcttctggaataaagagacattaatcatacacaaaagcagaattatatacaattcttatggtgcttatggattttacagaacctcttaatatagttactgattcccaatatgcagaaagagtcgtcttgcacatagagactgcagaatttgtccctgataatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctataacctagctctggcctgtgttttaccttggtgtcttctggaataaagagacattaataatacaatggtggatgatatttctgaggtgttcttggatttgatttgccagtattttattgagtatttttacatcaatgttcatgaggaatattggtctgtagttctctttttgagttgtgtctttttgtggcttgtgtaccaaagtaactgtagtcttgtaaaaagagtttgttaatgacacttctgcttctattgtgtggaggaatattggtattagctgttttttgaatttctgatagaattctgcactgaaaccatctggcccttggctttatttgtttgggagacttttgataatgcttctgtttcaatagggttataggtctatttaaattgcttatctgttcttgattcaaatttgttaagtgatatctatcctgaacattgtccatttcttttacattttccaattttgttgagtacaggttttcaaggtatgatctgaagattctctagatttccacagtgttcattgttatgttacctttttcatttctgattttgttaatttggatgttttctcactgccttttggttcatttaggtaaggtttatttaccttgttgatgcccctcaactgaagaatggaaaaagaaactgaggtacatttgaacaatggagtactacccttcggaaaagaacaatggaaacttgaattttgtaggcaaatgtaaggaactagaagaaaccatcctgagtgaggtaatcaaaccacaaaaagacaaacatggtatggatactagacatagagcaaaggattaccagcctgcatttcacaaagccagagaaataggatgcatgaatgaccctgggagagacatactttgtcccctggtgaaggggaaaaggacaagatctcttgagaaaattgggagcatgtggaaggtaaaggggagttaggagaaagaaaaggggagaagaggaggagaaaagaggacatgacagagcagggagatccagtctggtgaagaatagaggagagcaagcaaaaagatatcataatagatggagccattataggtttaaagagaaatctggcattagggaaatatccagagatctacaaggaggaccccaactatgaatctaagaaatagttgagaggctaccttaaatgtccttcccctataatcagattgatgactgccttatatgccatcctagagccttcatccagtagctgatggaagcagaagcagacacccacagctaaatacttagccaaactcctggaatccagttagagagaggagtgatgagcaaaggggtcaagaccatgctggggagatccacagaaacagctgacctgaacaagggggaattcatggaccccagactgatagctgggaaaccagcataggactgttccagaccccctgaatgtgggtgtcagttaggaggcctgggcaatctatggggcctcttgtagttgatcactgtttatccctagtacagcaatggactttgggagcccattccatgtggagggatgctctctcagcctgaagacatgggggagggcctaggccctgctccaaatgatgacagactttgaagatcccccatcgaaggcctcaccttccctgtgatgcagaaagtggaaggaataggggattagttgggccaggggaggaggggaaggagaggaaactgggattggcatgtagattgtttctaatttaaataaaaaggagccaaaatttctgcaagagaaaaggagagggcattttttttcctatgccctcttttataaatcaattctaacaaaatttccaagaactacaatttttatttgtaaaatgtctactggataagaaatattttgatttttctgttacacaacagggagcattccattgcaaaagtgagacagttttaggattgcatggagttttagatgtcatcttccttctcctgtacccttttcccatctttatcctaacataccagacagatgagaaaagagaatatcacagaaaagagaatatcacaatttcacttgtgagccaattccaacagcctgttgggtcagcgagttttctcttccatgttatctcgaggggcaatatttgttcattttagagaataaaataatctaggcaattgaacataaaaatacttttttaatatctagagctatagttgttgaaatttctctagatccccaccattttgttttaaaaccttcatcctgagataatgcacctcctttctcctgttgcctgtagacctcagccaacaaaccttcttgtatgacttattacattttctatttcaacagatcattggagttcaaacctaattattcatgtcaactctgtatgcttcttgccactgcaggttccttttgagaagcaacagcatataaaacataaggaaaattttcatgaaaacatttagcaatgaggtcaatgtaatatgcagtttacatctttttaataaaatgttagtgatttacctgagtcaaaaaagacattctattaattttattcattaaaagaaatgatgaatgctgttccatagaggaagatacagattaactagaaattgcccaaaaatatatacattaaaaaactctccctttctattatgtagggattatgtaggatgcttaatatgtacatgctgagtgcaagtgccagttacttgtttttcatgttcaacaatggaaggtttgtaagctgagagggcagaatttagagtacatgttgagaacaggaagttgggaatctaataatcaagtacactgttttccagttgcattattgattctaagctgtttggatacttttgctacttgacttatgacagtggaaccttgaaggcacagaaaagtgaatttctaggagctaaagttctctaaatcatgtatcaaatttaagaaaacatttctttaccccaagtaaaacagtcttcaccatttctctttttgattagtgtttcaaaagtggtagaaaatacacaaaaacttagaagtgaaatattatttgtattattttactgtaagaaaaccaatgaaccttttgtagaaatcatataccaatgtcaattaggcttttacgtgattataacaatacaaattataaagccttatagtttattttattattataaataatatatatatagccttattatatcccactgtatttgagtttctattacaaagaacctggtagataaaaggaagacatgtgtgtgtgggtagtgggtcaatggaagtaccaagaaagggcatagtggtgatgcaatatcttgaatggaagccattagagttattgaggtaggtcaagaagtatttgaagagcagaggaatacatttctggcataatgccagataagtgaaaaagctccattattgaaaaggtgtgagaaatatcagtgagtttttggtacatttcatgactgaagtatgaggaagacagatgaataatttatcactgagttgtttcttaaaggacacatttattcaataccaattaccttttcctcatttttcatgattccaattatgatgtgtgattttgattgccaatattagtaaatttaaaatcacctaggagattggtgaagcataggtctggggatgctgtgaggatgtttctagattaactggaaggaacaacccaccttgaatgtgagtggcggcatcctatgggctggagacccagttagaataaatgatggaaaaggagagctagaatagaatcaatgttatactttctctgcttactgtcacctgtgagttaatacttctgctcaatgttatcctcatcactgtgttcttcccacaatagcctagaatctatatagatagccatgaaataccacaacctctgaatctatgagccaaaaataaaattttccactttttgaagtagtcataaaatctcacatatatctgaggagctattggcaattgatggctgttgtgggagaggccagctttcctcaagggtgtggcccctgtgaggctgcacacattccagtatatggtcctatacttgtgcacctactggcagcactaagtgtggacttgggtgatttatacaaaaagaatacatgaaattgagagataaaaattgggatatagtggtgaaatttgaggcagaggaaatgggggaatcaagacataccacagtgattcaaaaataaaatggaacaaaataaatattttaataatgattatgtgtacttagagttattaggcagatatctggtgttaataagtcaagttcctgttcctgcttgctttgcttcctggtttataagaattgaattttaatttgagccttaatattttcttctgggcctggcataattcactttgatgacctattttgtacatttcttctcatttgaaactggtgcattcccttggttaggttcttcatgtgtattatttggtctttcttgaatgttgaaggctaggatgtccatcccatttcctgcagcaagatatcagacagtgcacttgattctgtgacctaaggaaaccatgtgacacttttgttgcttggacttttacatcattggaataagtgaatcttcagtcctagaagtccatcaagctatggccccttcctaaaatgtgtatatggagaggatctcacagtaggcaagagggaagtagaaaggtattgatattttcagagagtatactagtaagatacttcttgcattcagaaacactttcattgggaagacataatgaagacatgatagaatagaaatgtcagactttgcatatatctgatattataggttttggtaagagaaatcactttaaaatctaagtgatactgaacatgttgtgtcatgtttgggagcaaagagaaagttgatgttctcgaagcatggagagatgctccagaggaatgcaggaaggtcagaatataatctctggcctagaacaagagaaggctaggatgtccatcccatttcctgcagcaagatttcagacagtgcacttgattctgtgacctaaggaaaccatgtaactcttttgttgcttagacttttatattggaataagtgaaaattttgtaattattaggataaaatgtaatatgatgtagtctagtgtgagagcaccaaactctaatgggcaagcaggtttctatcattccttcatagtagaggatttagcaatgcctggtgtgtgcatcctccacaccagaataaaatttaataaagattataagtcaacacaatgagagacaggcctcataacatcctgtttagtccaccaattaggcccatttttgaactacatatagagattagtataacactaattcatgtggaaaatgatagactttttgtggttgcaatactttatttgaaatgctaccattattgttttaattattttaagcttactttaatttacatcaactaatatatgcatatctacatgacattttggatactatgtttcttgaacttttctatttatagtatacaatgcttcaatcttaccccttctgttaaaaacacttataatgaaattctagatagggcttcaatttacttaatgaagtatatagctactatggagcaatattttctaaacaaagaattaattgacctatggatgacaatgtatgttagcaatgcgttcttatgtaggggatatcaaatacaatattttatctttattgaaggggaggatgcatatgtatatctagtttgtttaaataaataattttaaggaaaatatgacataacattgaatatgcaaaataggctttggctattagaggaaaatataaaattctcaattatttctatgtaatgtcctttcacacagggacagaaggaactgtacactgcaatgctcttttctgatatgccccactgaacttgtaccaagaatgtgcaagcagctgcttttgaaaaaaactattgctatttatttatttatttatttatttatttatttatttatccatttatttgtctgtgcagaggacaacttgtaagaatcagtgctctccttccccaatgtaggtccaggcaattaaactcaggtggtcagggtttgcaacagctgcctttacttgctgcaccattttgctggcccagatacagcctttaacttgctcattctgtatctatgaattttcaggccttttaagttgtcagggacataatatttgccttttaaaaagactcagtatgggtctcttattcaagcattacaaaatgaacaaaagagctgttgaaataccaactctgagtgactcagtgggaaaggcatatagtttagcaaatatactaatggtcagtatttattgataattgtcaaataggaaactgttcatccactaatttaccactataaaagcttgaatgcttgctgcaatttaaacatttatgatcctacaaaatgcatgtggatgtaggcatggtggcacagcatacatgctcagcacattaagctggggcaggagggcagtgagtgtgtgacccgttgggcttcagagcaatactgtgtcttcaaatcaccacacagaggtgcaatagttagtcaaacctaagatgcaaggttgataggaagtgcttaggtcaagaagctcctctgtcatgtatgggatgaaagcccctatgaaagaggcttcacacagagttcattcagcaccttcttggaaggaagcacagaatatccactgaaggattggactggtgcaaggcactcccttgactgcagtgggaacctgcacaggacactatacactgtctttgcatcttggacttcagaacacaaatgcctgttgtttgtaaattaccaggcttaggtatttcgtcataccacgaataaactaagataaaactttcatcaccctcatttccagagtctgaacttagtagattgtccatacagttctatctcagggcttcagaagttaaaactgagcaagaaatttactaattcatcttgatataaaaacattcattttcccagccagcagcagttgaaaatttttacttatatttggctcttgaatttgaggtttttttgagataaattttgctatgtaactgcgattaagtggaactccccatacagccatcttggcctcagatttatggcaattctccagagtactgggagtataggtgtgaaccaccacacctggccttctcaagtctatttctgaattattttttctatttctttatttaaattagaaacaaacttgttttacatgtcaattcaagttcccaaaactttaagcctattttgataatcactaaaacattcatagttaattttgattttattatagttcagaattatttatttattcacctcttgtggaaaggtcctagtctttcacttttctccttcttggttttcacaaaatgtgcttttctgggcagaacaggctgtcatttcatttggacccaggtttgtttttcttcagctgtgtactttttctgatcattttctttgatgccttaaaggaagctatcttggctcctggagtgtttactatgctcaatatacatattaatttccttggcatgaacttttcccttaacttgtttgtttagaacaatgccatgactggcaccaatttgaagaagctgccggcttctgtgaaagctggaaatttcctttgtgaacagacttctgttgcctccacatccacatctgcacctttctcagcaattcacatatgtatagtcaagggaagaaatccatgttttttgacaagaatcaagtgttttctttttctttgtcttcatcactttgatgaattgttggaagaaagttatggttgaagtttcacttgaacctcttttaaaaagcaaggcttcaccttctctactcctggagatgatgaaagaaagccagcaatacagctataagagaaaatcatggacttgtgctcccagaatgtttctctgagccagtgatcaaaatgtattactgttccttgatgtcttataacaaccatgaaatgaggaagatggggaagaagtaaagatagtagcagtcttcccaccaaaacctacagagcagatgtagcccacctctggaatgaagacatatcccctgctgtcgaagccctgctcttcttgcgtaactgcttcagttcatgctcattcttaaacagagacagttttgaatgggatcccagaacaaagggtagaaagagaaaggaggctacacagaggaaacatcatcagacactgagaattcctgtctgaaaactgaactttcttgctctttatcatcacctggtcctgttgacccagataggacttgctttccttcaggagagaaaaaaaattgaaaagacagagcaatgaaattaacagttctctttgctttttaattaagagatgtttaaatggctaaaagaaaagctgattataagcaggtatggctgctaagctcctgtctctccttggggcccattctgttcatttcccttccttcttctctctgggctgcagttttaaacaattctctgctgagatcccagggttaagtagtgtgggaaatcacttcagcttaagcatgttaagtttggatgagggcatagaattctagaagaaattgaaacttacaattgtgcttaattggctttaacccttcaacatattgtgctgaactacaccgggtaatgccgtgtactgctatgctgtgcagatgttaggatgtaaactccgttaaacgcaaacagcacttgtcactccatcaactattcaaattgtcagagatgtatcagccaaccctaactaccctctgcaggcaatctggagccagcctgctgtttaataaccagcatttaacaagaaataacatgtagatgtggcatgtggtttaaaacattgtgttaagcatcattaaaactcagtctcctaagaaccttattaaaagagttatttcctcgctataataaaacattttctgtgactgtttcgatctagcagctaacaatacaaacaaaatgcctcttaatttagcatcccactagaggatcattgtgactatggaactgtaaaggcaaggaaaaagaaacaaccccaaaccacccttgccaaatcatcagtaatcagtgaaactgcagcactgggtgggggggcgtgttggagtttcaaatttatttttacagtgtttttttttaattctgtgttattatatggaggctatgcctttcttcataactggaaaggaaggttgctgatgacttagaaatgggccctggtttgaaaagtcagcattttctaattgggggatgagttggtagagaactcaagcaactgcctacatggaatttccaaggaattcatgtgatcttgattctaatatttattttaaaagaaaatgaaattagcttaccccacaatcagcctaaaatcttcccatcctgctattactcaagaaaatacatgcataattataccaaatgatggagataataattcaaatcttctatgacagaagtgtaaggcaacccagttgagtttcagctcttcctacttagaaaatacattaagtcagtttcccctgcacttctattcccagcacttagctttagagctaatgatgtggacaaaatatgacaatgtgttgacagaggaggctaatgagttagacttagcgagatttcagtgtgatttttgaaacctcaaataactcccctaacctgcatgatttaaaatgaataaagaggtattcagtattgtatcagcttaagggatcttgccccttttttccttgaaactggactaaaatgcaaatatatatatatatatatatatatatatatatattcatttttagtttatcttagctatatggctggggcatgtcaagatttaggtttctattttcatgaatactatttatccaaatattgaaggaggaagaatttataccatagatttgtacaagttcattgcatttttactaaaatatacagaattgaggacatagaccttgagataaataatattttaatcatttctagtcagtgagtcataattttcctttaaaatttatttgagtgtttggatgacaaataccagagtggttacattttaagtcatacacatttttgtgatgatgatttgataatacaagctatgaacttttttacattagatggtagtgtatatacattaatggtatttctcctgtaaattttctctggaaagatttagattgtacagtttctttcaaggtatcataattatgtgaactttttttttcaggagaggaaaacatccaaacatatacatttctctagcccattcctcctctagccttaaggagaggtcccacagaagtttcttcattgatgaatcatgtactcctcacctagttctatgtgggagtgatcacatagccacttggaaaaccaaattccttacttgggtagtgtcagctcagatctattcctactgcccattataggacagtgacatgctctcactctttctcttatctctgaacagagagactgaattcactacctacctttctaccacattaaaatagggcccaataaaatatgccagttgattcccaggaggccctctggggacggagccattagtgaagtgaacaatttaattagagtgtagagtgtgaaatctgttcagggtagtgagagatgagatcttatccacaaccagctgtggcttccttttgaaatacctctgaatcatgttcctctgtgacattctcttgtatgccacttgcaggtacagtgttcttcaacaatttagagatgtcacattatagtttatcttgataggaaatgtgtcttttaaagtcaatttatgtaagcataatcttgtcctttggaattacagatttaatgtaaattagatcaatatgctttaactattctaaacaaagtttcatatctagattatgaaaattttcaagaaatggaaaagttactatgtaaaattttctggtattaataaataaaataaaaatgttaccatgcttaaatgtaaattttcattcattaaaaatcaaatactggggtctggggaggtggctcagtggttaagagcacttgctgttcttccagaggacctgggttcaattcccagcacccacatgacagctcataactgtctgtaattccagttccatggaattcatcaatctcaaaaaacatatgtgaaggcaaaagaaacccaccaatgcacatgaaataataacataaaaaaacaaaaaaagaaaacccaaatattggaatgtttattgaaagaatatattggtattacagatccaaagttgcaaggacagagattctgatgttgaaataattatctatatggatttgagaaatgacttggcagtttggggtatatactgatcatgcagatcaccctagtttaattcccagcatccaattcaggtgactcaggactgcctggaaccccagctccaggggatctgacccctttggactccataggttccagcatacaattgcacaataaccacatgcagggacacacacatagttaaaaataactgaataaaattttaaaagaaagtagcataaatgccaaggaaaaatgcaaagagcaatgggtgcataggaaaaacacatctgttcataccaaaaattctttttgctcactgcaactatagatgagaatacatcttctaggtacaagaaacaacgtgcacagcaaatgtacaatgacaaagcattgaaggagcttaggatgctggtcactacaggttacactgctagagatttaaatgatatagatagagggtaaatgttggtgatttttgaggtctacagcatgtaagatgtgtttaaaatggtcacaattttcagccatcatgaataatagaaaattaaatctgagcaatttagaggtatatagagtttaattatgaatttgaattttttgatgacagcctacttgggtaacttaaatatgcattaaattgaatggtagaatgtgactctggtagttcagtaaagtggtgacaaatatcaaaactagtgtaccacaactcaaaaaaatatgaagacagtcactggcaatacaatgaatagagtttgtaatacttaacaactgattaaatatgaacttcacagagggaaggataaagatattgggaaatgcctggcttgagcgtgatgtttctcttaataatcttcatacaccaagaagatataacaaatattctcaatctatccttctatgttttctgttttttaaattggtgtggagcatcaatccctggctttgatgggtgaatcttgtttggtgacaccttatacatggagccatcatatatttacattttagcttaagtcacaaacctctttctagactgcagtctcatttttccattaccacacagtcacatttttccattgctaaatactgtttaattgtcttatgttcatcatctgcaatctcttaattgctcttcattcactttgcatgatgatctattgaagtcatttttcattggtctccttctatgctgatgtccaattccctttcagacaaataactatgtaaaatggaaatctttcattttttgtcactggattttgttccctcttgtcctctcaagtcattttgtactaatctctacatcctgtatcaactacataactgtgctttggttatactggcctcaatttcttatttcaatgacctgacaaattattttcactcttctcaaatgattcatttgtttttccaactcttaacacaaaactttcttgttcatgtttcttggcttagttatcacttcactgaggaagtttatgatcccagtagattccagtgagactctagtaacttacttatgtaatgtgctagactgttttgatgtatccctgaataagttatcttaagaccatgcaagtgtgtaaaattgtaatataacaattcagagtaaggatgatcctaggagaaggaataaaactgaatgcaggaaaatgtaattagcagttaaagatttgtggagcttgtttgttatctgcatcagatgtaaaggagcttaaaggttcaaggataagagcactgatgtagggaacaatatggtcaatgtggtcacaaagtcaattatgaatgtatggatgtacagaagactaatggaaaatggcataggctgtttgcaagaacattaaaaaaggaatactttttgaaaatgttttaatgaaaacactaaaaatagcaatgagctgttagtagaatgaagagcacatgctgacttgagagagagagagagagagagagagagagagagagagagagagagagtaattccagtaagtagatgtgtggactaatacagagaagaaagcagtagaatgagaagaaattaaaatttagtaatactttctggatattatggattagaagaagagaaaggattttttcatttaaacagaaaatttaggttaccatcaatcattgataaagattgagccttcatatggttaggtgatactacttgtctcctgtcattaaacttgttgcattggaagtatgacaattaaattggtttctacattttaacacacagtcaagacagggtgattttcctgttagtgacagagtctgtcagatatgcctataggctaaatcttgtcctacagttgtgtttgcaatgatcatgatctgcgaacaatttacaaggttggaaaataccacaagaagagaaacatttacattagctgctttaagcctgttgcactctgctataaatctttccatttgttaactcatgtaacttacacaatcattctgtaaagtagatgaagatatcttaagcaattagacacaggtcatatacccaatgagtaggccacagtccaaagagaaattcatggggtcttactgcaaaaaccatgtttctcacctatttcctatatgaatatttaccaaacacagtgtgggagagagagaaaaaaatccattttggtgaattttaagagagccaattgtttctggttacaaagaagtaaagaaagctttgagggagaatgagaccatactttcagcatactgtcacagaattaattttgaatctcaaccaaacagaatctcccacaaaaaggtgttctactgttctcagaagtaaaactgtattgtgatatttatactttactgctatttttaattataataattgataatatgttgatatttgttggtgcttcttgttataaaaatatcttcatactatcctagactttgtattttggcccacaaatccacatattcattaggtggtccttcataggaaacagttaatgacctatggcttagggaaccatgttgcaacttaatcacaatttaaattggaaaaaaagcagtgtgtataagccaatgactattatgggtatctgataagacaaacttatcattttttcactctaaggatttaagtaatttctctctaactcttggattctcactaactggagcaaccaaaccagaaggaatccctgtgcagagagttttctttttccacaggggtttgtccatggggaagtacatctgctcttgctgtttgaggtttccttgttagcttgttcctccccagcaaccaacatcaattgtcctctgtgcatatacacacttaatttctgccaaatttcaccagatgttagttacattctgagaacagaagatgggcaggatccaaaatcctagggaagttatctcctgccagagctcacctgaattctgtgggggaaacacatgcaaagcaaaatccagtgtaaatcgtctcactttaaaaaagttcaatatagattaaacattttccaagggactccacacatttgtattcatatagtatatggaggagtaggaaaatatttttattgtttctaaaatgaagcttatgtcattctttttagctctttgtttgtttctgcacatattcaggtcaaactgaaggtgaacttgatgtgattgatgtaaatatcttgacttaaactgaactaaaatcagttgtgaagaaatggaatgccagggagagacaattgtatagatcccatcactttgagaggaaatgtctttggacacagatgccaaaaaggagttccaaaagggaaccaagatgaaggctatagttaattaccttcttttcttcttacatctctctatacagctttttatcagctgaccttgaagagagagggtaccaggttaagagcagatagagtaagccggtagtaatgtttcaatgtctgagaaatgtagaccatcactcatttttcaggaacttgtcaataaatatttacactgtgttttacaactttcccttaactttgttatatagtatagcaagtggtacttactagtcttttccaatggtcaatgtgtgagtattctattgttatgggaaaaaaagaatagtcagaccaaggagtgattctttcaaagagcacaaaacataagtagattaaataaacaggaatcacaaatgaagcattgttctttttggttctcaattctatgacatatggtgagtgaaagctcctacaaatgcagaatacagatgaataatggaatattatctgtgtagatcatttagaatatgtgattaggattaatcctttgttatgtgctcaaatacctaagaaaatagcagcataagttttatgttggtataggagcattcaaagactttcaaatttaggcttacaaattcttgtatagaatgataatctataaaagtgacatgtatgataagttaaaaatcatccagagttacttatttccaggaaaactaacaagattgacactagagaatagttggtttagaaatcatattccacagtagtgtaacaacaaacaagtggtcataaattttcagtgtgtagtacagtgactgtaataaactcataatcataaatactacatctaaaatttatttacaaatatgtaataataatgttataatgttttcagagtatgaaaagagtgagaaaagaataataacaaactcaaataccatgctttgatccaattgggaatgttgcagattctaagagaaaagttaattgaaaaccagttcagtctgctgttcactttaaaggtgattttatatactaaatttcagtagtcaataaaatgcatctctactcctttaagaaattcatcatgattcctatctttctcctccactctctggtagagaggtgagtcccatgggctcttctatcccacctccccctctttgagccaccagacccttcctggcaccaatcacccagtaggacctggaggcagtaaagaaaagccagcatcatcggccatcattccggtcttgccccttcaccttctgggagagagagagaaacagagagagagagagagagagagagagagagagagagagagagaatagaaccttgaaagcacatccactaaaagatggagagaccccacctatacccactggaagaggagataggaagatgacaatatgggaacacatccagcaatagaaagacttatatgacactaccagagtctagggactctacatcaccaagacatgaacatcccaacacagatgaaacagaagagaatgccctttaaaaacttcatgaaaatgataaaggccctcaaagaggatatgagaaaaatcccttaaagacatgcaagaaaaaacaaatgaagaactgcaagaaaccaacatatatcttaaagaaacaaagaaagccaagaaaaaacaatcaaacagatgaagaaaacaattcaaacagttcaagacctgaaaagtgaaatagagacaataaagaaaacacaaactagggaatggtagaaatagaaaagaggagtaaatgatcaggaaatacagatgcaagcaaaaccaacagaatacaaaagatggaagacagaatctcaggtgctgaagataaactagatgaaatagattcatcacctaaagaaaatcttaagtccaacaaattcctcaaacaaaatatccaggaaagccaggctttggtggcgcatgcctttaatcccagcactagggaggcagaggcaggtggatctctgtgagttggtggccagcctggtctccagagcaacagagctagtgccaggatgggctccaaagctacacagagaaatcctgtctcaaaaaaccaaaaaaaaaaaaataaggaaatatgggacactgtgaaaagaccaaacctaaaaataataggtatagaacaaggtgaagaaacccaactcaaaggttcagaaaacttattctacaaaatcatagaagaagaaggacaatgcctatgaaagtgcaagaaacttaccaaacagtaaatagactggaccaaaataagaagtctcctcaccacatgataatcaaaacaccaaacatacagcataaagaaagaatattaagagcagaaaaggaaaaaggccacgtaacatataaaggcaaacctatcagaattactcttgacttcttcgtgtaaactctgaaagtcagaaggtcctggatatatgttctacaaacactaagagaccattgaatccagcccagattactatactcagcaaaggttttaatcactatagatgagaaaacaagatattccatgacaaaaccagatttaaacaataaatatcctcaaatccagtcctacagaaacttctggaagaaaaatccaacccaatgaaattaactacactcacaaaaacataggcaatcgataatcccactttaccaaaacccaaaagaaaaagcagggtaaatacacatacaataccattaccaacaacaaataaaaaacaaacaagaataagcactcagtggtccttaattttcctcaatattaatggtcttaactcgcctataaaaagacccaggctaacagaatggaattgaagacagaatccatccctctgccgcatacaagaagcacacctcaccttcaaagataaaagttacctcagaattaagggttgagaaaagattttctaatcaaatcgccgtaagaagcaagaagctgtagctttcctattatctaacaagttggacttcaaactaaaattaatcaaaagagatgaagaaggttatttcatattcatcaaaggaaaagtccatgaagatgaaatctcaaatctgaacatttatgccccaaatacaaaagtatccaaatttgtaaaagaaacattactaaagctcaaatgacacattaaaacccaaacacttatagtgggactcttcaacaccccacagtcactactggacagaactaccagacagaaactaggcagaaaaacaaaggaaaaaacagaagttatgacccaattgggtttaacagatatctacagaacattccatacaaacacaaaagaatatatcttcttctcagcatcacatggaaccttctttaaaatctctaaaattgaccacatactcagcaataaagcaaacctcatcagataaaaaaaaaatggattaactcctgtatcttatggcttaaaattagaattcaccaacaatacaaattaacatagccacacaaaaccattgaaactgaacaatgctcaattgcatcactcctgggtaaaggaagaaataaagaaagaaatcaaagacttcatagaattcaatgaaaatgaaggtacagcatactcaaacttatgggactcattgaaagcagttctaagaggaaagttcatagcactaagtgcacacattaaaaaacaaaaacaaaaacaaaaaactggagaatagccacactagagaattaacagaagacctgaaaactctaggacaaaaagaagcaaactcacccaggaggaatagacaccaggaaataataaaaaatgagagttgaaatcaataaagtagaaacaaagaaaacaatacaaagaatcaatgaaacaaagagtaggttcttcaaggaaatcaacaagatagacactcctttatccaacctaatcaaagggcagagagagaacatgcaaattaacaaaatcagaaatgaaagggggaacataacaatagacactggggaaatacagagaatcatcaggtcacactttgaaaacctgtactccacaaaattcaaaaatctacagttttctggatagatatcacttaccaaaattaaaccaagaacagataagcagtttaaatcgacctataacccctattgaaataaaagcactcatcaaaagcatttcaaccaaaaaaagcccagggccagatttctaccagaaattcaaacaagagctaatgccagtactcctcaaattgttccacacaatagaagcaggagggacattgctaaactcttttttcgaggctacaattactttgatacccaagccacacaaagatacaactacaaaagagaactatagaccaatatccctcatgaacatcgatgcaataatactcaacaaaatattggcgaattgaatccaagaacacatcagagaaatcatccactatgatcaagtaggcttcattccaggaatgcaaggatggttcaacataaaaaaaaatccatcaatgtaatccaccatataagcaaactgaaaaagaaaaaccacaatcatctcattagatgctgaaaaagccttttatttcccttttttattagaaagaaaattatttaacatgtcaatcccaggttcctctcccttccctcctccccctaactaacaccctacctatctcataccctttctctcccaagggaggatgaggccttccatagggtcttcaaagtctgtcatattctttgggatagggcctaggctaacccccttgtgtctaggctcagggagtatccctccatgtgggatgggctcataaattccattcctatggtagcgaaagtactgatccactacaggagttcccatagatttctgaggtctcctcactgatacccatgttcatggggtctggatcaatcccatgctggttttccagctatcagtctgtggaccaagaactccccattgttcaggtcagctatttctgtgggtttcaccatcctggtctggacccctttgctcatcacttgtccttctctgcaactggattccagttcagttcagtgattagttgtgggtatctgcttctaacttaacaccagctgctggatgaaggctataagatggcatatgaattagttatcaatctcattatctggagaggcatttaaggtagtctttcccctgttgcttacataattagttggtgtcatctttgtagctctccagacatttccctagtgcctgatttctctttgaacttacaatgtctccctctattatataatctcttatcttgctctcttctgttcttcccccaactcaacctccctgtcccatcatgtcttcctcactcctcctcttctccccttctcattctcctaatttcctccccccaggctcccaattttctcaggagatcttgaccctttaccctgctccggggcaccatgtatatctctcttaggttcctccttgtttaccagcctctctggcagcctggactgcaagctggcaatcctttactcaaatcaaaacaactctgggataccatcttactcctgtcataatgggtaaaatccaaaataccaaggacagtttatgctggcaaggatgtggagaatggggaacactcctccaatgcttgtgggagtgccaactcttacagccactttgaaaatcagtatggagattcctcaggaaaatgggaatcagtttaccacaagaatcagcaatttcactcttaggcataaacacaaaagatgcacattcctacaactaagatatctgttctaccatgttcatagcagcattatttggaatagcaagaacctggaagcaacctggatgcccctcaactgaagaatggatacagaaaatgctgtacatttacacaatgtagtaccacttagtggaaaaaaaacccaatagaatcttgaaattcacagacaaatggatggcaatagaggaaaccatcttgaatgaggtaacccagtcacaaaatgacaaacatagtgtgtactcaatcatatatgaattttagatatggagcaggggattgccagcctgcaatcacacagccggagagtctgggaaacagggaggactgtaagagagacctgcatggtactctggaaaaggggaaagggtctagatctcctaagtggattgggaccatgagggaagtgagaggtagctttgaaaaagagaaggggagaagatgagtggagaggaggacatgggggagcaggaagtttgagttggctgaagaataaaggagagcaggatgaaagataccataatagagccattataggtttgaagagagacatggcactatcaagatttccagagatgtacaaggatgataccaattggcaatctaagcaatagtgaagaggctactttaaatgcccttccccaataatgagattgatgaatgctttttattgcatcctagagccttcaagaagtagttgatggaagcagaggcagacacccacaggtaaacactgaactgaactcctgaaattcagttgcacagatgaggggggtaatgagcaaagggatcaaggacaggctggtgaaacacacagaaatagctgtcctgaacaaggtaaaactcatggaccctactaatggcccagaggccagcatgggactgatccagacccccctgattgtgcttgtcagtcaggaagccttggcaatctattggacctcaggtagatcagtatttatccctggtgtaggaatggactttgggagctcataaagggatgctctctcagcctggacaaatggctctgccctggatgatataacagacttttggggatcccccatggaggaaatccctggggaaagaaggggggatgaggtggggagttgggtgggttggtgagaggaataaggggaggaggaggggtttggattgacatgtgaagcaggcttgtttctaatttagttaaaaataattaaaaaaagaaaaatatctttgtcgtgtccacccttgaccagcaagaatgacacaccgaggaatcttcttcacacagtttaattgggaacttgatttacagtgaatggcagccccgggtagaggaagacagggcctgatatagtctacatctaccaatcacctaaccctacgtggtgcaccaggataggttgtctccaagcataattaagatgatacatgacatttaccaaattaggagttgtttaccacagagagcactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagacagacatctatttgtctgtcagcatggataaccatgcttgaggggattgtcctgcttccacagcagcaagggcctgtaccaatatggcagcttgggatttttgtgatttcctgatcctgcataggcaccacaggcaaacaaaaatggctaacaacatcatggaaagcataactcctaccccagcccattccttaactaaactaaaggcttgcttaagggtagttaagagggtattaacagtgggcaggcacaggtgtgcagcattcacggcaacaatctgttgtgttagggtgtctgtcaggttctcgaactgttgactccaatttccctgaaggtaggcactcagctgccaactcaggttgctgttctccgtgaaattgttggctatcctggaggtgatacacaaagaagaaaaggaatgaatgcatcctatggaagttaaggttactaaatcatccacctgttcctgcaacaggtccactctttggttcacagttagaatgccagcttttaagtggttttcaatagatcttaaggcagttaatgttgtggctgttttttccacaatgtcattgactgtctcagctattggtacttgccaagatggggagtaaattcaaaacctggagttatctgtttaagtttgtgatctggactctgacagggcgtccaatgaggaggatagcctcgattgggtgcacaataaggcaagacttgaggagcagtggagttctcttgactaaagtgtgaatttgagggtcggagcccctccatcagcatcagaaatgtagtgatatttacatccttggtcccatttgtaccagtgccaaggccagaactagcgcctgtactaatctgagtcaggactacagtgagtctagctggaacagtgagatttttcaaagttttatgtattgatagattcttaagagaaggtcccttctcatctacagaaccattcttcaaccaaatgcacgggttagaattattaaaaagggagaagcataatgctccatggagagaaatattagtggctgaatactgggtagtgtcagggtctaagtttacacaaggcaagcccaatttccagttagtagaaaagaaaacaggcaaaactttagatgtgctatgaacaggcaagggaattggccatgctttcgctatcgcccacaggatttgttctctggcctggatcagccatggtgttgtcaaagtcagcagcaggatcaatatcggaggcttcatcttgtttgttgcaccgccttatggtctctctggaatccacactgggtcttgctgatcctggggaaaaacacaaacaaaacctctcacccatgctaacactgggtccggtccatgccatagacccataaggatatctttccatcttatgtagcccttctgatcaggtgcctgagtctggtgtctatcggcagcagaaaggccttgagaatccaaatttaaaaaattcagagtaaagagagccaaggatagttgttcttttagtgttctaccatggcctattccccctttatgttttaataaacattctttcaatgtgcaatgagctctttcaactattccttgtccttggggattataaggtaggccatggtttaattggacttccatctgtttacaaaaggaggtaaaagattgagctgtgtaagcaggaccattgtcagtccttaattgctgaggttttccccaggcagcccatgcctcaaggcaatgtccaatgacattgcgagccttttccccactcataggggtggcatggatgatgcctgaacaggtatccacagacacatatctcattgccttttgatagaggtccgggaaagttgatatgagctctaatatgttgtataaaaatttctgatcgtgatgccagatcaacttttgcaactgctgtaagagtttgcaaactgtactattaggtttgataggtcctgcaacctccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatataggctccacagcctgtcttggatccatcagtgaaaatatttgtggctccagcaataggagctgctgtagtcattttaggaaaaatgacgggatgttctttaaaaaatgacattagagggtgttttggataatgattatctatttctcctgaaaatctgcagcgcagaattgcccaatcattcacagttccacaaagaatcttaacttgttgagcaatatatgggattatgatcttatttggtagtctcccaaaatattgaatgcattgctgtatcccattttgagccaagtcagcaactgctgcagacatctaatctttggaaagtccactctcaaaggagcaattgcttctgttacaaacaactgacacatagtaggactattggccatcccctgtggcaacactatccattcatatcttagatcaggttgttcatgattataagagggcagcataaatgcaaaacgccctgaatccttggcacacaaaggtatggaaaagaaacaatatttaatatctttagagatgataggccatgatgcaggtaaagaagttaaaagtggaagaccatgttgcacagggcccataatttgcatctgctgattaatagctctaagatcatgaagcaatctccatttaccagattttttcttaatgacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataggaatacctccctcagtggcccctaggaaaagcccagacctagattctttggtcttacttgtggaataataggactagttcaaccctgcagatgttttccgaggccttgacctggaacatatcccattcgtttcatgatatcttgagatgtttctgagtattcatttgtgagtttaaaacccatatcctttaacaaatctcttccccatagtgaaattggtaagtctaacacataaggttgcatggtccctgaatgcccttcctgatctttccaaggcaattgtctagcactcatatcaggagccttagcatagcctaaaccttgtaaactttgagaagaaacctgtataggccagccagagggccaatctttggtggctttaatgctcttatcagctccagaatctagtatgcctaggattttcttaccattcacaattaactcaagggtcagacattgatcaaggtctaaagctaggaatgttaagtttgatccagtggaaccaaagcctccctctcctctctctctggtttgagctggaaacttgtcatgtaaacttggcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctggacccccattctgggagttaataagagtctggtggtagagcgtaagtccagcccctcggagcctgtagtggctctcctcggtccctcggatgttgaagagagggccatgtttcgggactctgctcctggttctgatcctccatggccccatatatttgtgggccctcgggtcgtgggccccgtcgtccatttttggacgggctcctccataccccttaacaaaaggctgtccactgatgtcttttactgatctacaatccttagcccaatgatttcctagtacagtgatctacgatctcattgccttttgatagaggtccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatctagggcataagccaggttgcttagagctgggggtagagttattgactttagtaattcctccctctgggcattgctttctcaaatgcccttgcttgccgcatttaaagcaagctcctgaaattctgcctttcttagttaattgcatcatagcagctgctaggccagcattggtcaatggaccccctaactccctacagactttcatccagacttcaaggcctttacctgtatatggagttattgcagccctacactcctttgtacattgttcataaatcagctgtttgatcaatggcatagcagcatctggatccccaaacactcgtcctgcagattctaccattcttgccacaaagtctgaaaagggttccataggaccttgtaatattttttgtaagatttccactgatctcacctttgttgggcagagacctccaaacactaatggctatttggttaatctgatcatacacttgaggaggttatcctgtctgttgctgtgcaaaacgtccttgaccaagaagcatgtccacatcccagtatggattaccagccgcgcggttagccacactttgatcattggtaaactcaatttggaaagctctccaatccaaatattgtcctgatgataaacaagctcttaccaaattcattcaatcactaggtgtcatacagaagtgagtgactgcttctacctgagcaattgtaaaagctgccgtcactgcataggtgcgtaccgactctgccagagctttgactattttaaagtcaatcggctcatgatatctctgttggttaccatctgtaaaaactggataagccagtggtcgagcaatctggaactcagtgctaacagtacgccacacttccggacagaaggtggagcaaccaggagctcctacttcctctttcaagcagtaaggggaggagtgatagggcggtgccctggctttcattcgccattttagggcgctgtttttctgatacttttaaggaatgtttttccatgagctcaataatctctccctccttatcctccatgaggtcctcatcctcacatatatcctgctctgattctgaatcctctcctggttcttttaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcctgtggccaccgagagattgcctgaggctttgaaccagggtgcaatggtgtcgcattcattcaggaacctctgcaacgttgctttagttaaccttaaatttttaaaatgaagcagctcttgaagaacaagaaaaattggatgtgattgtgacgatcccattgtgcttttgttttagtttgtgtgctccgaaggcgtgcaagtgggataacaccaccagaaaacaaaagctcacactgcaatgttaaagagcagccgaatcaccactaaaatagcgtggtccattcacttactcttaactctgcaagttaaagcaggagcgaggtgttttgcttttggtttgcttttgccgagaacagtcttgctcctctctggagaccttatcacctctttcctgagggccttgttgctcctttactggagaccttatcatttcactcaccttgggaacttaccagcaccaccccgactgtgagaagttctgactccccgttcgggccaccacttgttgcgtccacccttgaccagcaagaacgatgcaacatggaggaatcttcttcacacagtttaatcaggaacttgatttacagtgaatggcggccccaggtagaggaagacagggcctgatatagtctacacctaccaatcacctaggtctctaggtcaaatctttagcactttgttaaccatgaatcagaacacagctattctccttctagaggatataggggcatgaaagaaagacagattcatagtacaaccacatgctgaaaaatatagtttagatccagtttgaaaagtataatgccaaaggatattaaaagacaattttatgcaatagaacaaaatggtattgcaataataataataaacataaccaggacacatctcatttgttcatttcttcatactttttgtccttatgtatgaatgttgtcacaaagactcccccaaaacattcttatttatatctggtctcctgaaatttatggtagatactaccaatgaaagtcattagctctttgctgtgtaatggatactcattggattaaccagtgtgagttccatgattgtgcttgaacacttgttctatttactgatgccatagatttcactatgattcataatttcttatgaattttacttcatgaggtcataattctcctttcccatttctgtgtcagttgtgtgttctgggaattctggtaggatctaagtactaaattgcatacttggctaggattcttgaagtaaatgaggtgttttaacttgaaatttgatcttttttcttaaaagtccaactgaacctcagattttgatgtatctttattttattataaattataaaattcaagtggcttttgttctgaacaaaagtgtaaggctataggataattcactactcttacttgaacttaggaacaatgtggttatattttatttctattgtaaatagtgcccagtaatccatgatacatacttgggtgaaaatgcataatttctcatagaatacgagtatttataatatattaacaattttacttgtatacatttatgtatatgtcaccaaatggtgtgaatgtatatgttgtgactaaatgtttcatcctggctagcagccatcaggaaagcatacaacagattaattcattgtgattttttaatcacatgcattcttaatatgaattatttgtttaattaacaccttctgcctttacaagggttgttaacatatggaagcatctgctgagccttgcctcctgatgtgattgaaagaattttgaatttaagcattttccagatgcatgaacacacattcaatgggctatgattggcatcagtctcatttaaccaagtggctttgtgtgtgaaactgtcaaagagcaacaatccattctgcgtatattcatagctcttgtcttttgtcttttgatcaagcctacaatgacatttttttctggttaccacaacaataaaatttgctagacattttaattaactaggaagagttaatgtaagtttaagaagctttataaaagctggggctttgaaaaccaggtaagaaacttcaatgagtaggacaaacttctgtacactgatagactcttcatttttatttggattagcatttgtgatgatcctagaaccagcataataaatgtataaagtaaaagtcattcagtggataaaaaaatgaaagtgtcaaatataaagagaagttacagcaagttaaactggtaatgatttgattaacttgaagaggaggtgtgcatgttggtaaaaattgaattggtttcattgtgtaattgttagtagaagaaattgatgaaacaggccaatagtttagccatatctggtacagattcttgaattgcagatgtctttggtggcaagaataaaaatgaatagactcaagaaatagccagtaataaaagataaaataaccgagtttgagtccctgaagttctgatacattaagagataatgaaggaataatcttagagaagaaagtctcacagttataagttgatagagagaaattctaaatatttaagaataagcacaaatagtattaaggtccaaaagaccacaatgacagtatacaactgtagaagtattcagaaaaatctgtataatataatctggctaatagtcaagttctatgaggttagatttgtattttttcagcattattattgaaattgcctattttcaagagatatgcatgtgtgtgtgtgtgtgtgtaaatttgtatatgtgtatacacatatgctattcctgtctttctacattttttttctttcacagtgtagagcatcagcattgaaaaacagaaaacatcaggttgaatgctaaatgaaaaatataaaaatagaacccatggactcaatatgttgagaccactaagactgaagaaaaataaaactattcattctttccaattcttattttaaactgaagtggaataatgcatataatcactttccaaaaaataaaatttaaaaacacaagagatgcttgaaaattttagggccccagtgtccatctcttgctgtcattactcacttgaaagtccctgttacatcttgagagcccagaggaggaggtaggctgagactgggcataaagatatgcagtctaatcattaaggcaattataatgttcaagtagaagcaggctggagcaaacaattaaatgactgaaaactaggagctttcaatgttgtgtttgagtatctgtctttaaaaatgttatataaaagaaattcagaattaaatgtaaaaatggaagacctcacacagctatagtgggagacttcaacaccccattctcaccacaggacagaaacaccacacagaaactttacaaagagacaaaggaattaacagaagttatgaaccaattgggattaacagacatctatagaactttctatccaaaaacaaaagaatatactttcttttcagcatcacatgggaccttgtcaaaaatcgaccacatactcggcaacataccaaacctcaacaggtacaaagaaattggaataatcccctgtgtcttatcagaccaccatgctttaaagttagaaatcaaaaacaaaacaaagtgcagaaaacctacaaactaatggaaattgaacaacactcaattgcaccattcctgggtcaaggaagaaataaagaaagaaattaaagacttccctgaattcaatgaaatatagacacaacatacccaaacttatgggacactttgaaaacagtactaagagaaaagttcatagctctaagtgcttacatgaagaaactagagaatagccacaccagagagttgacatcacagctgaaagctctagaacaaatggaagcaaatccacgccagagaaacagaagccaggtaataatcaaactgagggcagaaatcaataaagtcgaaacaaagaaaacaattcaaagaatagatataacaaagagttggttcttagagaaaatcaacaagatagataaacagttatccaaactaatgaaaaggcagagagagaacatgcaaattaacaaaatcagaaatgaaaagggggacataacaatggacactgaggaaatccagagattcttcaggtcatactttgaaaacctgtactccaaaaaatttgaaaatttaaaggaaatggacaattttctggacagatatcacttaccaaaattgaatcaagaacagatatgcaacttaaacagacctataacctctaaggaaatagaaacagtcatcaaaattctcccaaccaaaaaagtctggggacagatagattcactgcagaattctaccagaaattcaaagaagagctaacaccaatactcctcaaattgttccacacaatagaaacagaagggaaattgccaaactctttttatgaggctacaataaccttgatacctaagccacacaaagatacaactaagacagagaattacagaacaatatccctcatgaaaattgatgcaaacattctaaataaaatactggcaaatcaattccaagaacacatcagagaaatcattcaccatgatcaactaggcttcatcccaggattgcaaggatggttcaacatacgaaaatgcaacaatgtaatctgccacataaacagaccgagggaaaaaaaacactagatcatctcacgagatgctgaaaaagcctttgacaaaatccaacaccccttcatgatacaggtcttggagaaatcagggataacaggaacatacctcaacataataaaatcaatatacagcaagccaacagccaacagccaacatcaaattaaatggagagaaactcagtccaattcctctaaaatgggggacaagacaatgctgtctactctctccatacctcctcattattgtccttgaatttctggctagagaaataagacaacaaaaggagatcaaggggatacaaattggaaaggaagaagtcaaactctcactatttgcagatgatatgatagtctacattagtgacccaaaacactctaccagggagctcctacagctgataaacaccttcagcaaagtggcaggatacaagattaactcaaagaatctgtagccctatgtataccaatgacacattggtggagaaagaaatcagagaaacatcacactttacgattgccacaaacaacataaaataccttggtgtaacaataaccaaaaacatgaaaaacttgtatcactagaattttgagtctctaaaaaggaaattaaagaagataccagaaaatggaaagatctcccatgctcttggataggtaggatcaacatagtaaaaatggcaatcttgccaaaagcaatctacagattcaatgcaaacaccatcaaaatcccaacacaattcttcacaattctttggtgctggcataactggttgcagacatgtagaagactgcagttagaaacaaaagacccaggatagtcaaaacaaccctgtacaatagaggactttctggaggcatcaccatccctgacttcaagcaccattacagagctattgtcctgaaaacagcttgacattggcacaacaatagacaggtagaccaatggaatagagttgaaaaccctgatattaacccacactcctatgaacgcctgatttttgataaacagtccaaatttatatgatggaacaaagaggacatcttcaacaaatggtgctgtcataaactggttgcagacatgtagaagacttcagttagacccaagcctatcacacacataagaaaatattcaacatccttagccattagggaaatgcaaatcaaaacaactctgagataccatcctacttctgtcagaatggccaaaatcaaaaacaccaatgacagtttatgctggagaggatgtggcgaaaggggaatacttctctgctgctggtgggagtgtcaacttgtacagccactttggaaatgagtattgcgactcctcaagaaaatgggaatcaatctaccacaagatccagcaattccactcttaggcatataccccaaagaagcacattcatacaacaaagacatctatctgttcaaggatgttcatagcagcactgtttgtagtagccagaaactggtagcagcctagatgctccttgagaaattgtggtacatttgcacattggagcactactcagagggaagaaaatggaatcttgaaatttgcagaaaaatggatggaactagaagaaaccattctgagtgaggtaacccaatcacaaaaagaaacacatggtatgtactcactcatatgcggattttagacagagtagaggattaccagcctacagtccacactgccaaagaagccaataaaaaggaggaccctaagagagacatacatggttcccttgtagaaggggaaagggtcaagttctcctgagcatattggaagcatgggaagagggggaagggagctaggagaatgagaaggggagaagaggagggatgcagaggaaatgagggagccaaaaggttcagtcaggggaagaatagatgataacaagaatggagataccgtaatagagggagacattttagatttacagagaaatcagtcgctagggaaatgtctggagatctacaagatgacaccagctaacaatctaagcaacagaggagaggctaccttaagtgcctttccctgaatatgagattgttgactaacttatatgccatcctatacccttcatccagcagctggtggaaagtagaagtagacacgcacaactaatcactgaactgaactggaacccagatgcagagaaggacaagtgaagagcaaaggggtccggaccaggctggtgaaacccacagaaacagttgaggaactcttgctccctagactgataactggaataccagcatgggactgatccaggccccaggtacatgggtttctgtgaggaaacctcagaaatctacgggacctcctgtagaagttcattacttatccctagcataggtgtggaccttggtagcccattccatatagaggaatactccctgagccaagacacatggggtaggcctaggccctatcccaaatgatatgatagactctgatggcaccccatggaaggcctcaccatccagggggagcagaaaggatatgtgatagataggatattagttaggaggagtggtaggggtgggcaggagggagatgggaactgggattttcatgtaaaacaattctgtttctaattcaaataaaaaaagttgaaaagaaataaatgtaaaaaggggtagctttggaggttagtaagttcaaatttaaatgattaggaaattaaaatggctgtgagaatttgtttcataattcaggggtgatgggattcttaattatttacaaaaacagaaaagagaaaatcaaaaagctttcaaaagcaaataaaccaacaaattaattaaaatatttattaagatattaatttctgtggctaaatatttctctttactactttctatgaagaaggtgtgactattttcttctggacatgagcaatctggggtagttctgttcccaaagggctattgattacctgaaaattatggtggagagtcagaggatgctaggatattcttttcctctttttttctttaatgaattggtcaagtgacacctgatgctgtatatggtacctggagatgcagcaccatctttgtgaccatgaggcaataagcatatagatgagaaatcatgccctgaggatggtggcacaaaaagactaaaaaaaaaaaaaattgattctagaagttctcaaaagataaaccactagctacaactgtctgttgtattttcttgcctgtgagataaatgtgcttgatgtaaagtttgtgtttattttgttatttcaatcataattattcctagcaccatgtcttcagaattctctaaaaaatggctaaaaacatcatgcctatgaatgcttgtgaactttctctggccctataagaatctacttctcattcagagtgcctagttttgtgtcttgggcagtctgtgggacccactggcagtgggtccaggatttatccctaatgcatgaactgcctttttgcagcccattccctatagagggatacctcgctcagccttgctcctgcctcaacttgatatgccagaatttgttgactccccatgggatgtcttacccttactaaggagaagatggagggttgggagggggaaggttgggggagcctgagaaaatgagggagggggaactgtggttagtatgtaaaatgaaaaaaaaccttaaatacataaaaaaatttaaaaattctactttacatacgctggcatcttttacatgttttaggtaaagggtgatcttatttattttaatgctttttagatggtttcaggaataaatgtcaagcctgacagtcttgcacttactgtgcatccttcactaggctttctccccttccttgtcttatctatcccaatttcaccagattcataaaattttttgttggatgatgtttatgcagtcttttgtagggacatccaaccaacagtgatgatggtcatttcaggggtctcatggccaatgttctaaagccatggccaatgttttagtaacataaacacatatgtatgaggaacttgcacaagaggcttgggcagaacgaagagaatgatagcagtttgtggtctgagtagtcagctcttttatgtggagacacccatctgaagaatatcaaggatgaatcttcccaagcagaagattttctatgcacaatcagatgggccaatgccatctacagttcctgtcccatccagacaaggattgcttgatggaggacctcattcagaagactaaatggctagcttaacatgtcatgatagaagatttctgtgattcagaaacaaacagaaaaccaaagccattcacagaacacaaaaaaatattgtttataatattgtttatataataagactccaaacattttaggctatcttcttgatatcacatgacccttctgttctccaaaagaaaggtaatggatatttcaccttacaacttgggaaaagaagaaattgagggtgggagagcagggtttatctactctaaagtcatggtttattttttctgaggtgttgaggtgcagaagttcaaagaggtgggaataggatggtgctggaagcttccattctgaatgtcacatctgggtcattttcataggaggcatggtactcttcctcagaaaacttttgtagaagcagtgccttttctttgtttgcatttattctgtcttccatagtttctgtttggtgaaggtttcaaactcaagcagaatattgatatagcaaaatgcataatctagaagttggttttatttctcagatttctgaagcagtcaaagtcaaacagaataaagcatatatggatttatttttttctcattttttattagttctttgagaatgttgtataaagtgttttaatatccttatccttcttgctttatcttttccagatccactaccctccccaaacacactcaactttatatcccctttttaaactcaataagaacagttagtactcctaaagtgtagtctttagctgatgtattgtcaatctaccaggagccatagccttgatttttgttgttgtttgttctctttttgaaaggacatttctctgagtctctgtggctgtcctgaaactctctctattgatcagcgtggccttgaactcagagatctgcctgcctttgcccccatgaggcctgggattaaaagcaggtaccaccattgcctggcttccacgcccttgaaaacttactcccccccccaagcagctatcactcaattcttctcatctatggtttctatctgacctgagcttgtgtgggtcttgtgtatacatactcatctactttgaatctgtatgtgcagctgctcctctgtgtttttttgtagtcatagtctccttttagctcttacaatctttccatcccttctccacaatgatccttgaggcttgggaggaggagctaatgatgaaaatctattgtttaagggtttagcactctacagtatcttattctctgtcctttgactattcatagtcctctaggttaactgtaatctacagtagaaagaatcttgtctgatgaggtttgtccgatgcattaatctgtgagtactaaggaagtgattcaagatagattaaatatggtgcccttgtagcagagtaatagcagaggttcacacttagggcttattacttaattacttattacttacttacttacttacttacttagtcataggttcttgatgtgggtttcatcttgtaaaacttaaatccaatcagaaagcaattggttactcacttgtttatgcctctattgcaccagtgggcatctttccaggtcagtaattactgtagctcatagagtttatagcttagtaagattgatgatttttttcctctggtgtaatgtatatcacctcccattactatgaaagttttctcataggtttggagcttccagctcaaggcaagcttgatttctccatattccataacttaagatgtgatatcttcagaaatatggtcttactatcaagttctgtagagttacaaagaatattgtcaatatgctataatgtcttgggtggggctgtctatgaaatctcagcggtcaataactccaaaagaggccttctattcctggcattgaactatttatttgttagcctgtcttatgtattagggacgctgttaccctgttgcaaagtaactcttttgaaatatctatctatctatctatctatctatctatctatctatctatctataaacttctacattggcaggttctaaataactgttttaaatgtctttagacttacttatcccttcctataaatttgttgcccttattcccctgatacatttaagcctttttgtttcattattttgctttaaagatgccactgtgttcaatatcctttccaatgtaatccgcctcccaagagtctttactaacttcctgacttctgtatgcatttcaaatgcaatacacagacttgaaaattaaaaactaacattcccaaataagaaaaatagcaaaaatttcctaggttattattttttattaaataaccagaatgattgtttccagttccacccatttatctgtgacattcataattccattttcttaacaactgaataatattccatttttgaaattcatcatattgctattatctattcatttgatggacatccagtctgtaagatacagcttgtaataaataaacataaaatataaacagtgaccttgaatgttgtttagattttcctttactagaaaatgtgacatgtcttgggttagtaacaatctctatgggaaaatttcaccagcagaactgactggtatcgagagaatctcagatgggacttttgtattagctctagtatttactgaccattttgctttgatcaagctacccactgcccctgtctctcgctctgctaaatgagcatttggtaataataatctccatggacactctaggtatcagtggctttatctcagcttgcaaacagaccaaatgtttatataatattctggatttgacagtacataataatcagattattaaatgaataaatgacttgtttttggatgtttactaaaacatttgatcatcactttactgaccactaaggcatgttgagtttagacattgaggtatagattcaaatattattgccatgaatgctctggccatttttgtagaagaatggtagccttgggagacagaaaattctaagatgaaggagaaaactctgggaactgtagcttgattttagtcagtcaagtgattttgcaattgtcagatacatttcttttcacattcatgaatgatttcaatagaaattcttagcacaattttaccatatgattaaattttcttggtgtttatagatgttgcttatgaaggaacaaatacaacagatgcagaaataacacacaataaaaccaatttgtatattttaagttataaagtactgtgaaacaataatataagtaaattataaatcatatcattatgaaattgttccaaatatttctaatttttaagatgtcaaagtgaccaatatgatgtttactggtttttatttttactacattttccattagtcaaaatttaaaattccacacttgtttgtgtctgaatttactaatatgtttgtctttcttagggaatgaccagctgccatggtggaaaacattgcaaattattctaagccatcattggtgaaatgttagacttctgtaatgagtaccacaatcattgtgttagtgcaaggacagtgggatggaagtggcaatcatgcttgcactggaaggataatggaactgggtatggagtgtttgctctaaatagaaagagtaaaagaaaagtgtaaatattaaggacctcatcatattatcaggacacaggatgacatcagcttgcttaaggtctgattgttactctttgcaatatcctgtttggtttaagtgaaactacgaaggaactcatgggtttttgtaagcctgggtatcactgatttgaggaactaattcttgagattgcaacataaaaaaataagcatctgggggatgagtagagcttgaattgttctattttgacaaagaagggaaacaattactttgggaaaagtattagtcctttaccacgaatgatttgtcttcttgggaaagaaaagacagtgtgttttctaggatagtacaggttaagtaataaaatatgttcttgacttatgaaggaaaatatgaccagttttgaatagtgttagatgtaaaataaaaatgaatcttatataggaattaattaatttctaaaatttattttgaattcattttcttgttacctgtgtaaaaatattttatgtactctctcaataataaaggtacatgttctctttcttttttctatttttattgaaaatattcatctcttatacaatgcttccctatcacagtttcccctccctcactcctccctgctttccttatttcaacattcccccatatccactctccctctgctctcattcttttccagtcattaaagtctgggataagatcatcattttagtcctactaaatgttctttactgtgttctttactgtgtgcatggatgaggagttaaaatctagggattgatgaaaggtaagctatacatggtaaattgcatattttctgcaattctggctgtaatcctgtgtctgtgtcaacctgatccctgtgttcagatggcagaattagatccaatgaggcgataaaaaaaaatcaacattagaatatggtttccctagagttgcactcaattgcttggttcactgagccatgttacttctgaggtggttctgaactgatcctattatcttgcaggcattttaggcatctgccaggcaaactagagaggtggttcaagtaaccataaccctgccctctctgaccagtcatgcttcctaaacagatcagtttgaaataaagtaataacatctactaatatgcacttactaatcccacatggaaacaaatcagataagggctggaaagtgatggacaatgccctctgtggtttactcaaagttttttagtctggcttttattatctggcattctcctgctcatctttacatctcgtatgtcttctttaggaaccaataactacttttatgctgattcatacagcatttggatccaaattaatcacattatgtttgcatctctattattcaaaatccaggcctaatatacaaatttcttcccaaaagaacaactcaaatgaaaatggctgtgtctggtttttaattccataccaccttgaaaatcatggaggactcagtatagtttagaggccatctgttcgctgttggtcaatgctattaactttagaaaatatctgaaaacagagactgcagggtttttttctcttccaattttcccataaaatccttcttctttatttcattagaaacaattaggcacattgtgctggtggagattaatactgaaaaatgtcaatggtgcgtctaatttgagaaaactattgagctgacaagtaaatagcaatacaatgaaaatgccctgacaccttgcttgcaggttaaaaaggatctgtgagaaggcaggaagagtaaagaagaaaataataatggctgattgtgatattgatttcagtagtttatgttgctaggatatctaatggatatatacacagaaaaacaaagcagaccccacagaaagatataaagtcatggctggcagacatagtcttagtcggaagtaatggtcatggaattcctcctatgagagtgctggaaatgaaatggtgaccactagtcacctttccttgctctgaccttcaatcatatggaacatgctgctctcctccacagcctgaaatgacttgtcttgccatcatatgtaatgtactgttctcctccaagtctgggttctgtaagaaactcctgaagacataacaaaatattaatataatagaaatgagaattcctgcctaggcatcaaacatagaaaactgtctaacacactgatctgactcactctctgtctttgtaaggccctaagctccccatgatggaattttgttgtggaattttacttatttatttatttatttatttatttatttatttatttaaaatgattgttgaatgaagtgggacaatggcatataacatataatatcacacagaactcaaacctcagtgccaatagacacaaccactctcacccatctctgtattgtctatagtggcttttgttatactgtgacattgctgaataattgccaaggagcatatgaccaccctgagagcctatagccttcactatttgaccttctacagatagttatagactcttgagataacaattacaaaaaagtttgaggcttctgttctaatactgattcttctcttacatatcaattatcaaaagggaagaaaggtaagaaaataaaaggaaagaaagttccaaatatctgagtcttattcaatatttttttaatgattttttttagttcaaattagcaacaagcttgtttcacatgtcaatcccttctccctatccctccccacatccccacccctcctacttcaccccgacctacccccaaccccatcctccctccactccccaggcagggtagggccctccacaggggctccacaaagaccaccacattatcctgggctgggcctaggccctcccccatgtgtccaggcggagagtgcattgcttcacatgggatgggctctcaaagtcccttcttacaccagggaaaaatactaatccagcaccaggggcccctagagtgtagagacctcctcattgacatctatgttcaggggtctggatcagtcctgtactggcctcccagacagcatctggggttgatgtgttcccccttgttcaggccagctgtttctgtggttttcaccagcctggtaccgaccccttcactcttcattcctccctctctgcaactaagttccagagttcagttcagtgtatatctgtggatgtctgcctctggatgagggctctaggatggcataaaaaagtagtcatcaatctcattttaggggaagggtgtttaggttatcctctccaacattgcctggattgtctgttcatgtcttccttgtaggtctctggaaatcttcctagtgccagatctctcctttgacctaagaattttatgttcacctatgttcatagcatcattatttttgatagccagaacctggaaacaacctatatgcccctcaactgaagaatggatagagaaaatgtggtatctttacacaatggagtactactcagtgggaaaaaagaataaaacaatggaatattggaattcccaggcaaatggatggaactagaagaaaccatccagagtgaggtaacccagtcacaaaaaggcaagcatggtacatactcactcatatattaattttagacatagagcaaaggactccaagtctacaatacacactgccagaggagctaggaaacaaggaggaccctaagataagactgcatagtacctcgaagaagggaagcgggaaaagaaaccctgagcaaagtgggagcatggggcagggagaggaaggaggtgtaaagggaaggagggtagggggaggagaacaagaggactgagacaggggagggatatataggaggacaagaaaggagatgccttgagagagggagacagtacagatttggagagaggtttggcataggggaaatgtcaggggatccacagggatgatcccaactaagaatccaagcagtggtggagaggatgtcattgatgcccttcccctataataagattgatttctacattggttaccattcctagagccttcatccagaagctattcaaagcagaaacaggtacccacagctaaacactgaaccatactcctggaatacagttgtggagaggtaggagagatgagcaaaggagccaagatgttgctggagaaacccacagaaacagttgacctgacctactgagagcatgaagacactagtcttaaagctggggaaacagcattggacctaagcaagccctctgaatgtgggtgccagctagtaggccaagacagtctatagggcctctaacagtggggccaggttttgtccctcgagcacaaatggacctttgttgcccattccctatggagggatattattgcagcccagatacagcaagaagggcctaggctctccctcaaatgatatgatggactttgaaggtcccatgtggagggtctcactatccctggggaggaattgggggattcgttgggggggggattggtgggaaacatggaggattggaggatgtgggaatgggaggggtggatatgtaaatatgagtgcctctacaataaaataaataaagaagctcaaacacaaagcaaaacaaaacaaaacaattttaagaactttcctttatttcttcattataggagatatccagagaatcagtatggggaagggagagacagaagagaagagagaagggacaagtagggaagaatagaaaagggaagaagaatggaaagtggagagtaaagcagaggacaagagaggagaagaaagtgggttggtgagaggtgaggaggagaagattgtttggagcttgttacacaatttgtagaacaatacagcatcttagaaattataattagagttgatgttacctaactggaatctaaggttttctagaggaaatcttcttctttttcagtaaaactgattcttttctcctgtggtcctctcctgtttgtatgaagcccacccaaaatgatgaagatactgcattttgctttgctaaatggccattgatgaaaatgttaaccaaatccaaagcacataaaaaaagcaacatccaatcttgtgtttgaccaaacaatgaaacatgaggactagcagtaatgatatattcattaactatcacaccctggcctaatatgttgaagttacaaaattcatctaccaaaagcactaatggataaaattcctattcacataaagcaagttgaacatcattgcctcattttcactttaaaaattagaaacaaaatgaattagcaagcaacaaaatgggaaaaataaaatttaattaggagtttgcatcaattaataaatctacacttttataaacacagagcatatctaacaccttaggggctcacagagactgaactgataattagggaacctgcatgggactgatgtaggccctctgaatatatgttatggttgtgtagcttggtctttttgtaggactcctaacagtgagagtgggatctgtctctgactcttttgcctgcttttgagaaccctttcctcccattgggttgcctcattgagccctaatacaaggggatgtacctagtcttattgcaacttgataaactatgtttggttgatattcccgggaggcctgacattttccaaagggaaaggaggaagaatggatgggggagaagaaaggtggagtgagaggagctgacaggggatgagggaatagaaactgtggtctggatataatatatgagggaagaataaaaaatatgattacccacagctatagtgatgctgcctacttgtgaccattacatttattttaattcagaaggtcaaatgatcttggaagaggaagttaaactccactgtatacttagattactatttgttatataataaacactaataattatctattaaaatacacaatgctgttagatttattttctgagcacaatttgcatttacatgtcttttatatgaatattgctttattgtagcaacattctaccatagcaacccagtctaaatgaacaggctgggtgttgtttgcttaccagtgtcttcagttaccatgatgtatcattgtgtaatctgagctattccaaagaatgaattacattgcacttacgcggtctattgcctacaatatacaatatacaataggttagctcccactgtgaagtacaaatagctgctgtaaactgctactagcctctctaaactgaggattgtccttggtcatattcactgccctacaactagtcttatattgaataaaaggatatttgctaccagctcataaatatcaccaccactaaaagcttctgtctgatcttgctgatgttactgcaaatacagggaaggaagggagcaaagatgattttctttcagtttgtttaggagttagaaatcatgatttctatttaccttgatgcttctaggacaccctggaacacaaatagccctccagagtcttgtttctttcctgtctcctgagttctaattatactaatttcttataatctttagacacttccaccctctatctatcccttaagagtccattctcttgatttattggagggacacctgtgtcccattagcaaaacctctttccatgtcaccatgcaaaaatgtatagatattttccttctcaataaatcttgctatttttataactgtagaagctttaaaatcagaaacatgaagtagacaaaaggaaactatttctagcttcaaacatgtacttactacatcccttgtgaaataaagtcttgctggatttaatatttaaagcttcaagacaagcatctaggagttactcaaggtttgttgtagaaattttacatttcaggcatgggttttgtcttaattactgtcctattgctgtgaagaaataccatgataaaagcaacttctagaagaaagcatttaatttggggtttgcatacagtttcagagggttagtgctttatcttcagggtgggggatatggtggcaggcaggcaggcaaggttgcaggagaattttatctgagagctcatatctgatcctcaagttgcaagcagagtcagtcaaactgggcctagtgtgggcttttgaaacacaaagccatctccaaattggcaaatctctaacaaggtcacacctccttcaataaagacacatcacctaataactccaaaacagtactgctaactgagaaccaaacattcaaacaaatgaacctatgggaactgtggtttttattcaaaccacagcaggtatctatgggaagcttgtgagtttcattaagataatacccaagtaaagtaatttgtgacttcccaaattgaaagcaatcttttctgattctttgccttttgctgatttttttttttttactctccatccttctctctatctcctactctctgtatgtgtgtgtttgtgttttgtttctatggtttgtgttttgctcccagtttaaatagatatgagatcaaaagtctcactctaaaaagcagtacataggaaatgatataggttctagggacagatatttgagctatgggctaacttttacttcttttaaaaaacacacttgttgttttatatacgtgcttgcagctatttctagtgatgactttttgtacatgattccatggttgggctttccacggtatgattacagcagttgttaatatcaacttcacatatgaataaaaagatcaatcttatctggagtcttatttcaattgtgttaatactgatgcctgtaaatgttaatcactcttctagagttgggccacactctcagtcttgaacctaaagatacatgcccaaaagatatgttagtctgatatatttgtacaaacaatagtgcttattctatgacagagttgaagtaagccaacaaatacacaatatagggagggatattctaaagaaaaatgatgatgttaaaggaagaagactatgatatgagaacaagggaggtcatgtggagataagaaaaaacaaaatcacacataccacatgcatactatgtgtatgaaacaactgagggcactttctgggcctaggccgcggcctgatggaacccacagcctgtcccaaatggggtgtagatttccaatatcccacttctgacaaccagataatagttgggaaattaccaatacggagtcaggtagaaatataaaggtatttaatagggaaaagccttacttacagagcgacctagccagcgggcgtggcagcagtctgtacagcaagtaccaaagtgaaactgaaagtgaaaatgcagtcaccctacatcccctgaccacaccctcgaaagcttgtgagggcgtggtcaggcacacctgtagctagcccctaagtaggcatggctacagcttcccccacaaaaaacaattaatgaaaaatagttcatgattttgaaattgagcaaagaagtatatatgtgactgtttggagggagaaaagggaggagaaaaatgaggtaattatattaaaatctcaaaaaacataaaagaaataagaagaaatattgtaaaaggcttttaggctaagcacacacccagcagagggcagacatccatgtctcatctgcattctggccttctgtttacactaagcatgtggtgcctcttgctcagggaaagaccattttgtaattgacttgtctattttgatgttcagtgcttgtatggtctagatgttattcgtaatgaatgtgatatagaagattcctttatatggaattttctctagtggacacatgcctggcctggctttttcttaaatagttgttggaaggttttctgggtaatcataaaatttgtgattgacaatgagacacacttgagttttaatgagtatattaaccatgttcccaggttgacagatgtgcagaactgcagacagctttttcctggatatgcttgttcattaaactatttttattgtcatcagatgcatctaccaaacaaggacaccatcttcaggagaagggccacttcatgtgcttcctgcattcaaggttcttatatcacagttaacttgctgtggaaataggactcactgatttatgtcccttaagttcagtttggaaaagttttatgtttcttaatggaatttaggaatataagtgcagtgaaacaacataaattccattcctaaatagattagatatcactagcttgctggtttgcttagtatttagttactgtttaaagtcaagctgatcactgtgactgctgtttatcttttaagaaagaatagatgggacggaagagatggctcaacaattatgatcagttgttgctcttgcagagaccctgagtttgaatcccaacacccatatatggctcactgccatttgtaacaccattttcatggaatctgacaccctcctctgagctccactgacaccattaacaacttaaataccaccctaccttgtgtaaactaaaatcctcatttctgcatttacagttcaaataaatggtttcttgctgtttctacacagatatcccatatgcatatttcttgtcatccccaccttttggtgtgtatgttcctgcatatggtagagacacgaacatatgtatatatgtgtacagggggaggatagaggacacactcaaatgtgattttacaggtactatgactctgttttgatagaaacactatctctcaatggccttgagcttgacaggttaagctaggatggctgcaagtgaacaccagaagtctatatgcctctgcttccctaatactgatattacaaattttcataatcacaccaaatagtcttacatggattcaggtccccatgattgtatataaagcactttaactgataaactgtctctgtagcccaattttctatcattgtatctccaaactaagctcttgtttccctggcatctcatactgtttatcatattgtcacagtcattttccagttttattgttcagattctagtgatggtcactatccaacacattttgtatgcaaaacataataataaagctgaatcttactccctttattcatctaattacatcctcaaatttgacaatatacatacaaaagtttactcactttaaggttcatcatgatcatattgtcttattagctagattacaattgtcctatgagccttgcctttcaccagtcagttgtttttccaagtgataggaagaagatggagaagaaaatggagaaagaggaggaggaagaggaggaagaggaggaggaggagaaatacagtaggtctatcaggttactctgctactctcactgctatctgaatgccttttagcccctataaatttagcaccatacaaacactgaaaaatactatagtccaggttgggaaaggtcagggggcatgtagcaaaaagaaaagagctaatattcttagtgaatgtcattagcaatcaacataatactgaagtttgtatgattttgtccttccagttctctgggttactcaagtcttacaatatcctacttctttgtcaaaccaccatcttcttcctcttaccataactcactattgctattgcctagaatggttctccccttagcagcttattggttctcatttaagtctgggcctgacatttaagtctttaagactgtccccaatatctgctagttttaaaaacattcaacatccctttagaaatgatctcttttgctttttatctttgtctccatgtctgctccccagtcagcttttaggagattttgtggtgctaactttgtattttccaggtttatcttaaataaattgattgaaatttagataggtttgcagaggaaacattgttttgaacaactgggaacacacacacacacacacacacacacacacacacacacacacacacacacacatacacacaacacacacacacacacacacacaatttttgcattatctatacaaggagaatttggtaacaaatggattatattattattatttctatgtatagctaatatataactaagtttctggctagattatggaatccttgtgcccaaacatttccaatagctaaggaatgaattatattaagtattataacttattaaagtgacttatataaaccttagtagcaaatattagtgagtcctcactatagaccacatgaattgaactgtttgagcaatagagctaaaggagaccagaacagaaaaccagacacttagatcacaatggcacattatctgataaattgtgggcacaaaatagctaccaagtatttacacaagcaattttacgttatgactttcgaaaaataaaacaaatgtaaatgagcaaaaaagtactcatctctaaggcagtaggtgtagtaagttataaatggcatagtttaaacaaacatatcattagagcagcagtatatatgaatcatatggacaagtatgtgattcatctttggacatgatgagaatattctgcatcttgagaatgcagatgaattcacaaattcatccaccaagatcaatgagttgtacattgtcaaggcttcaatttcttgcccaaaagtcatgccccaataaatctgattagaaggtagctatgttggaattaaatttatatttgtctttatgaaaataatattattagttcagacctatttatttcaggtgcatatgtggctacatgacgttttcattggtatgacatatcacagtgcacattctgtctctatgaaagagcttcactgttagatagccatctcttctcagtgcattagactcactggataatgagaacacatgactggcattatctgagcttgttttatctggttttgttttcaacatcacatacatactaataagcactcagcattctgtcatgaaaggagaaagaaattacatcaggttcatcacctttgtgttctctataagtgtcatcctcaggctagtggtatcttatgctcacagagcttctccatatttcttgtgccttagtctacaaaccattcttttacatggtgttgtcataatctacttaaatataatcacattatgtttgatcagagacaattggttcttgaatttgtagaaagttgtttcactggatgttgggtatatatttttagactcactctttagagcaaaatgtagcagatggttttcattgaagtgtccatttttctatgatttaaaaatacagaatctaatttcagtaatttgagttaggattttattataaagctactcttccttccctttaacactcacaaacacaaatcaatagtctgttcggtatggatgacagagacccagaccatgaacaaggtggtgatgatagccttgcagcatagcatttgtggttattcatttatcgagttttcgacaggcattttcaacactgcacactgaaagtgcttctacttttctttgtcagttttatttatatcgcatttgcatgtgttaaaatttaactctgcttttccacagagggttagattgctctttttgttgagtactcagatttgtttgtggcttttcaaactcacttttttccccttgatatccttgtaacttgtttaaaaactgggaccaaaaaggattttttatttttgtcttattacctgattttttaggggttcttaactttaacattgtataaaaatactgtgtttttatgattttgttgcttggtttatatacattttttaaaaaaaaaatcatcaccacagttttaaatttgtttttggttgattcttttctgttttctctttagccacaattcatccccagagtggcttccttatattaagtgtcaacctttgtaattacagtgtgagctttggaatcacactgaggaaatctgggcatccagtagtcctgtttctatattgtgatcataatgaactgtttgatcatgttaaagcctaggtatcccatggggctaggcatagttaaattaccatgttgtttagaaacttagcaaagtgcctgaatagcagacactcataagtactagctctttgtgcttaaacatgcatatccttggtctggggacatggatccatggttctaactgctgagaaaatatgaagacataagttcaatctccagcattaatatgaggagcacagcatccttatatgctttgttacatcaacactgagtgtaagaggggttggcaagacaggaggttctttggggtttgctggctgtcagtgtaaaaggggaaacctttttctaaggttagtgaaagaccccatctcaccaaaatacagttgggaaagataaggaaggacacctgacatccttttcttgtttctatatatgcactgatggaattgtacacacacacatacaaacaaactagcaaataaaaacataaaccttcttccatgtaacccttgtcctgaatcctagtctgaggtttacatgcatccattgctggcgtttctaaagcttagccttcctgacctttactgactggcagatacatgagggactcttagttcttgcactgcaattaactccatgtcttgcattgacctctgtgattttattatccacaatggatgctgaccctgatgagagttacagtcttggttgtagcctttgttattgtctttttgcagatgcattaatcatatctatctgaactctcaacatttaattgatatacaagcatcattacatattatctgttctttttttcaaagggagttaaaaacataaagggttatattgataataattgatttattcttcaaagaacatcatgtattccatatactattttactttatgaattgataagattttgaatttgacaactaccactacattatatctagtaatgaaatagaaaagctataggaagaaaaacatttggtttagtttataaaagcaacatttctgaattatatcaattggatttaatatcatgtttctattattgttgaatgagtcaacaatctatactctagttcctaactgaattctagcagtttagtaggtgtcctggtttgaatgaggaatatataacataggtagtctctgtcatttgaacatttggtccccagttggttgtgatattttaggacatttggtgatacatccttgatggaggaattttatctttagtggcaggctttgtgaaaaagaatccttgtgacatttacatttcttctctgtggcttgtgctcacaacagaagatgtgagctctcaggttcctgcttctgttgatatgcctgccacttgcttgttgccatgcctctacttggcaacactatgtgctcttgtacttctagaactgagaggcaaaataaattcttctctgagttgtctcagtcattgtgttttatcatagcaacaggaaaataacccatttagtaggcaaatgataacattttgaaaatgatactgaaatacttagatatttacctgtatgagataaggtagtctttttggttgctgtagctactaacttcaagcacatcaacattttagacttagggatacatgaggctttaagttatacatgtttttatggaaaattcatgaggtaaagtaacccttttctttttccaaatattgatatgagcaagcatggaaaattttacctatctcaacattcctcattgagataatactacctgtctgttctgcttttgagaaaagaaaacataaaaaagaaaggaagctagatgaattctttttgttgcaattagtgccagtgtatgtagtgaacttctaagtatccaagactaatcaagactgacagggctgtcccctgctaatcaccaaagatattggcttgtctggggggaaggaggagtgattatatcaaaacgaacagtcagctattgccaagacaaactgttaagaatgtctttgaattaaaagacaaagggatagagatgaaattaagtgtagtgttaattatcttccaataagaaggcattttatgggcttgtggcttgcagagaaagatgcattgttttctactcccaagatgtattttttagagaaaattttcttaagctatgaaatccatgtaataaaactcattataatgattaattctcatagtattataaagcagttaaaatgtaatagcttctgtatttcctaagtatacagaataaatgattgacccaaatgatatagatagactgacagcttgggggatggaactcagctagattttctgtctgtgcttgtgttgctttataattcacatacttttctgccaaacacaggttttacttaagctttgctggtgttgctgaatgtttagtttgcatgctattttaatacctttgtcaggtaaaaaggtagctggaaaagaactgatgtatagttagccatcaattcaacccctttccctaacttattggtgtcttggaaattttgcccttcctaggatgattctgtaaatattttttttcattgagcagaacagcaattttttgaaagcccagttgtttataaatttactcttctatttttcatggttgtgatgttttctatattgtctgtgagtctgctgtaaaggaaggttcagtacaccaaggacagataaatagacatcaattgagtggacagtgcttgctcagagactacctattggtatggcttaaccacaactgggttggaggatgacagagtaagaaaggagctgagcatcctttaacatcatttaaacaaacattcaagtggcttaaagaagagaaggtatgcaggtcagaggataccaagtagcagctatatagaataaacaagtctataggtggaatgaacaatgtgagctgtattcagttgtactgtgcatggggttcacacagagcagactttaactgactttaacataaaattcagtgttttactaccgctttatgaaatgatggatatgctgattttaatcccagctgacactgttttattctctgtggaatttttacaacatcatattctttgcattacatacattgtcagtatgtttagttagagtgtgttgtggaatctaactcagaaaaattgatttttgtaatcaagttgtctaaaaagtatgccatagctggttctggtttggaagctgaaggaggaagatttatgtgtggcctggacatcatgttgagaaggcagggttttaccttcggcgatgctaaatatgtgttcataactattagcctgcgcttcctttggatgagttggtcagggacagaataatgagttcatcactgtgataaagcatttttctttcagtgtgatgtttcaggccttgcacttgaagtgacttgtcagaaatctctagaattagttgcaggctattatgcacatatgagggtgctgtcgttgtttatgacttgaaataggtggagatactgtgcagtgatttgcaaattgtcaagatcaactaaatgaaaggctccaactcactacttgcaaatttttctgccaaaatcaaggattgaacgatgattctcccatagactactgcaggtcttcatttcattgttttcttcttatctttatagtcttacagtttgaagtatttctgaatgttctcaggtgtagtagacaaaacctaaatgtaacacttatacaaaatactaaagaagcccactaagtttctagatttggttaattaactttactccaaattcagtcacaacagaatcttgtttgcttcttcttcttaagtgtctctcagatcccctttgtctccattcccagcgacacagcagcttcctcgtgaccactggtactctaagggaatgtgcacactcctcagctggtctagtgacatagcatctttcccatgatcactggcactcttagggagtgtgcacactccccagctatccttcccgatgctcttctttttcttttttaactctgattttttattagaaacaagcttctttcacatgccaatcttcttccttcttccttccctcctcttctgtcccccaccccatcccaacccctttctgcttcccagggagggtgaggccttccagggggatcttctaagtctgtcatatcatttggagcagggcctacaccctcctccatgtgtctaggctgagagtatccctttatggggagagggctccgaaagtccatttgtatactcgggataaatactgatacactaccagaggctccatagattgcccaggcctccaaactgtcatccttgctcggggtctggaaaagtcctatgttggattcccagctatcagtctggggtccatgagcaaccccttgttcaggtcagatgtccctgtgggtttctccagtctggttctgacccctttgttcatcactcctccctctctgagatggattccagagttcagctcagtgtttagctgtgagtgtctgtctctgcttccatcagctactggatgaaggctctaggatggcatataaggtagtcaccaatctcattattggagaagtgcattaagttagttggggtcaaacttgtagataactggacatttccctagtgcctgaattctctttaaacctatgatggctccctctattgctgtatctcctttcttgctctcctcagttcttcccctgactaaatcttctgctgtctcatgtcctcctctcccctcctcttctccccctctctttcctgctgctcttttttatcttgtttgtttgtttgtttgtttgagacacggtttctctgtggctttggaggctgtcctagaactagctattgtagatcaggctggtctcaaactcacagagatccacttgcctctgcctcctgagtgctgggattaaaggtgggtgccaccaatgccaggttcctgctgctcttcttaatgcttatgtagtctttctctacactgcacctagtaagtactctctaatgcacaaatgaactatctatgctaacagtcctttacagcttccctgctttgctcagtataaagtcctgtgcctttctttatcactcttnnnnnnnnnnnnnnnnnnnnnnnnnnnnnnnnnnnnnnnnnnnnnnnnnnnnnnnnnnnnnnnnnnnnnnnnngactggtaaactccctggctgcccatttctaccctgtttccttttgttaggctgatttcccatatcttcacgttcatttcaatgtgactttacttataaggtcttatttttcactttagaattatttagggaatcctccttgttcttccaatcattttgacttattttatacttttttaaaggtcatgtgaccacccagttttttcaagtcctcctttagtcccatgtccaagtctggttcatgactgtacctctgatgtttagtctgataatggcacagagtaggagatcagtttgtattcactaaaccgaaaatgggatggcatcactccaagccaatctctcttagctatgttagataaagggaacagaataacatcaattttagatgattttcgaggcataaaactggcttatcctgaaataaccaagcatctgatacattaagctgattatgtgtctccctcagtcacagattctcctgagccagctcttcacagaccctctgcctatcttaaatatctacactgtttctctctcactcaggaagttttctgaacaagctctctggagatacttagcctgtgtttggaccaccatctctcttccttttgaccctcttcatccttaggtttcaccttctacctcaccatctcagtccttgtccacacacatctatatagaatgaggcttcctctgagttgtgctttgttttctggtcaaaatctgaggcttcaaaaattctacatgtaaatatatttaggtatcataggtacaaatggatacaagaggaagtggtttatgcaaagatggatgtatttatgtgtagagagagaggcatactcatggtagtaacagttacagaagggattacatttgatctggtagtaaatactgcaggtaatgaggattacaaagtcacaatgtcagtttatcctagagtttaactggaatctcaaatactagtacctttaaaccaaaaataaatcaagctcaaagtgaatggtttcaataaacaaactatcagtggattttacttttaatcatcagtcatttaggaatccttttaaagtacaattatgtgggctgcatgtacttatagtttttatgatatggctgtaggtgagacatgtaagaattaaggctctcatttgatacaggcaaatttgaattttcctctctatagcatttggatattcccctctatattctaatctgcctccactgccacccccagacagcccttgagaaagtgacatttcaagaagccaccagaagacagataacaacaactgattgctttagggttaatcgttagcaacatggttgtacttgtaacattgtttatagtgttcaattaaatgtcaatttaatgacagtccacatgtaaaccacagtgctgagactttatgcagtcccagcccagaggattgaccagctgtccacccttgctgaccctccagttgcctttccctctatgtttcaagggtacaggtaattgctaatcctgaaggagcccaaacaagctgttgtctagctgcatccatgatacttttcttaataggaaatggattgcacttttcatagtgccaagtgcccaacagcaaactgggtctgtgttaatacagtaggaattttgtttcctgaagcctgggttgaatattccaatgtgcatttgcagcctctttattagacattgcatttgagagaaatgagtgctattaccactcactctacagcagcccagttatctcttctacccaaccaatccatgtgggcttttgcaaataaggcctagacctgaaaatattcaaatttgaagagaacctacaaactgaccaaacactaatgtttgtcatgatgagactgccagtgcctgataatttgcatctaaagaaagaaatttgaaccaaagcgctgcccctgaaatgtgtattttattaatagactcccataaaaatacgatgctttgctcattcaaatatccgcaagtgaaagaaaataaaggatttggttcttttgctttttcccactgatcaactttcatatgttcttgactgaaatatattctgaagttaaaaataatgtttcccctacctatgtcattcaagcaacatggtgcatgtgaactttcccaataaagcagataagcaagaggtaggagacggaaataaagggctcaacagaggaacaccttataatatagtctgagaatgatggtggtactgcactgggtaatgtagggacacaaagggaaattatagtgttagtgcacacttttcatgacaccaaattgttgacatgccaatctaaagtaattccaactcttggttcataaaactctattgtcaacttcaagaatataagttttagaatggtctatctaactctgttctggtacataaaatgcactaataaacaatcaggaagtgggagaattaaatatgtcatctaaaatcaatacaacacacagcaacatctggcatatagtaactgtaagtattctatgcagctaatctttaatattgttgacagaagaatatcaaaagatttttattaatagtatatatttatatgttgataaaatacatatatgtagagagcataagagatatagggataaagttacaaaaggaggaagagtcaaatatagatatcaatactataagacagatttgtaatccttatttatgactagcgaaatgtgtttttataatctttacattataattatttgtaaactacacttcagtgcactggtttgtctttagtgcatacacctttgttttctatctcttctagctactcaagtgagaatttaattaaatttcttactccaataaataatatgattaaatgagatcagtgatgtctggtgactggaggggactatcttggcttgattgatggctttgggaatgcaatgctaattcttattttacactgcactctcacccttttctggtgttttatatgaggctccaacaatcagacagaacattgaataaggatattcaaggtttttagtcaattatttgaattattaatatttcttatttgggagtattaccattgtgattccatgtgaaaaattcactctggcttaaatttagttcatcctactctgtatttcatatctcttccttagtaagtatcaaaagaggtcaattttgtttgttaaatttatgtgtgttcttgaaaaatgtcagtgtttttgatatcattcttatcttttctcttttgtttatgttactacatatgtgatcatgatattataggataattatgtgtttcttctattctttactcaacatgatttcccctatattcatgtagttatatgtctttactactcttccctagatggactgtgatggtttttactaccaccagaagtgtagggtagaattctaccagctgatcacttgcaagtaaagaattgaaactccaaactcatatgcaaatttctacataagtaaatctccatagtgcatattgcatgatatgcaacttaatcaaaacggtttcatatgctatgtatgtcacaatgatacttaaacaatttgtgcataaactgaactaagggtagtggagttctgctgttgtcaatatgtcctgtgtcaagttgaacaaattgctgggtctcttaatgctgtccagatctaatgatattcaattcattggaaagactaaatgagacagcacgtgaaaaaaaaaaacagacattaggtactacagttactaattttactttttttcatttttatatctatctagtgacactatggaagtttagcttcaagggaattaaattaggcttgttttgagaaaataaatacttggacatattcatctttccttgacagtgtcctattagtttgttctgtgattctggattgatctataatatatcacaatctttatgctttcacataggttttcaggtagcattttgatataaaatgtgggattctcaagaattcattactagctgatactgtaagacagagttgcatggcttctgaaatgctaaacactgcagactccctttacacagtacacaagactaaggtttatatagggtatttaatgtttgaatcttgaaaacaaaatggaacagttttcaagaaagcaaagttataagtcatcaaattacaattaataaaatgtgacaatgacatcgatggcatgaagagagggacttgtgtcaaattggatgcttaccagggacacatctggccttaaacaccaatgccacatctgcctccttgtgaggcattctccactctgtagctgtgcagatgttattgtggggtggctttctaaatttgctctttgtgtgaccttatattattaaccaactttccccaattaagtaagggttaactgaaccaggagtaagaaaaaatgaatcatgaaaatgcaatagaatgcaatggatgttagtgtaccccaaagcaactttgttctaatcatataatgattaacaaagattttgggccttcatccagtagctgatgggagcagaaacagatacccacagttaaacactgagctgaactggaatccacttgtagagaggcaggagttatgagcaaatgggccagaccaggctgcagaaacccacagaaacagctgacctgaagaaggggaagctcatgaagcccagagagatatctgggaaaccagcacaggacagacccagaccctctgaacatgggtctctgttaggaggcctgggcaatctatgggatctctagaagtggatccttatttatccctagtatatgaatagactttgggaagccattccacagagagggatactctctcagcctagacacacaggggagggcttaggccctgctccaaatgatatgacagactttgaagatcccttatggaattcctcactctccctgggatgcagaaagaggatgggatagggggttggtggagggcaggggaggaggtgagggagagggaactgggattgacatgttaactaagcttttttctaatttaaattaaaaactaaaaaatcagtattattattaactaaatagtaaagaactataataattaaatatcaagaaaaaagatttttatactatcttgtaattaggaaacatttccttaataattttggataccaacaagagtccttattagagtcttctgtattttatttacatttaggaaataagcttcataatttgtaagaatacatttaagttttctagggtctaaagtctattccattcaagggagaatcatttttaaaggagtctcaaatgatcctacctttgcaaatttaacaaactttctcttttcagttcttcccttggtcttagaagtgcttcatacttgtgaatggctcagaaagagaagcttcatcaaatttaaaataagtcgaactgtattatttgagaatactttgtaatgcattataatcctgctttttttatagtgggaaaaaatttccagttagcatttaaacaaaataaaatgaaaataaaccactattctttgattctttggaaggtgtttctgactgatgagagagggatattttctctaaaatagaacacacatgctcacatatgtacatatatatgtatgtatgtagtttaggaggtgagctaggactaaacaccagcctagtcaaaattccttttgattcctctctacttttgaatttgtattcttcctatggtaagtaataagctcttagattatcaattctatttaataacagtatttataggggagtaattcccataacaagtttattgttaatttgttcttaaaatacatgtgtagaatttttgtctgctaaataaacttttgtcctcttaatcaaattcttagatttcataattcttaccatgacttcccagtgacacctgttctttagtcatttgaatttgaatgaataattttaagagtgtaacaaccaacttgtgtaaaattaagaaccttcaaggtgagttctgattatgtttttttttttttacatatgctgtctacttctctccttatgccagtacagactgactcttagaccacatggctttgcagaatgaccctgatacttgaacataacagtatttattccttcccattttccagtatgctctgcatagaatatatttcattttaacatgggctgacattttttaattctcaaattcataatttgtgttgacaaaagagtctaaagtttaatacatctggcttcctactatctgttttggaatagtttgattctgtagtggcaactcatttggcatgtgaattgatcatcttagtactatctccaaaacattcataagaagtaacatcattttgtagaagcatatattttctgcatagagtctgtatatagcaaaaaaaaagtaaaattcatcatttatacaaaatttgttttgtggcacagtcatctatttcaagaatatgaaatgtttgctttgtaagtgttcttagtccttttcctaaacatagtgttagtcatagttgtatagatattatgccactgctgtcttccaggagatggcatatgtcattggaaatgagcccatttggaaaatactttagggagagacatttgcactataactgataagggcatgtgtgattctaatctattatccagttttgtttgaggttttcctctttgaataaacttaaatactttgggtctcttaatgaaagttgtgtaaaatgttattaatggttcagttattgggacatacacacagagaaggagggagaggggagaaagagacagggagagacagagagctttcctcagcaatgccacaggagggtcaagaagctaaaaggacataaattgacaataaacaagacttgaaataaaacaaaaactgaatcaagaaggaagtacatgaaagtatgagaagatacttttcactttccaaaatttatatggatgctcagtgtatatgacagaaactatcaggctttcttgctgattatttattcttgaactagaaaatttatgtcttagtgactcacaatataagtaaaatcactgtacaattaatatctttttaaaagtataaattgaaattttaatttccacacacatacagcttagaaaaggcttactattttaaaaaaagagttgactttttatatgatagtaatatttttatcccactttattctaaccagtctgagatgctgactagatgaagtttatttgtttaactattgattattgttaggtttagaacagctggaacttttagtaacagtgattatggtggaccttgactttcttgtttttcaggtgagactggtaaaccatgaaaatttcagaataacagttgagtgagttaaaggaaggaggtcatggccttagaactttccccagagaacagaggtgtgacttcattacaatatggatggaagactcttcaatagtcaaactcttttgctgtaattaggttctgctatctactctatacaattctaataagtcctactttgcctaagtcatgtttggagtctgctgagggagtctttcctttctaaaaaaaaaataccaaacagcttttttgaagcctagtatttgttgtgctgtttgagaaacaaaaatctttaacaaaatcgaaataatcaagttcactccctgcttacgtgtctgttttccaaagtgaagattcagacattgcctcttcatcagcttctttcatgcctctcacttgatccttgtgtgtctctaaaatagcgcatgtaacaaagtgtgctctattctgtttaacaggtgtatctttctctttgtccaatgcaaacttataacaattcaccttggtgacttcttacttccatgctggtatctagattaatatgcctgataaaaagaccacttattttcttgggtagtcacatggcagtctcttatttactcgatttacagcatgaacaaattccaggaatatgtaaaatacaaggctatagttaaagaactaagactttctactttatgaagttttaaatctaaagaaaataattgaagaatagatttggttaaacattcattatacagttaaaataaaacaatatacagcaaaacaaaacaacaacaaaaaaacaagcaaacaaaaacacaaaaaatgcccaaacaaaaaaacagggtagtacagagaaccaaaggatggctagtgcaagattaattggtataactgaccatcagcaaacatacatcttggcaagagggagatgtatttccttcaagcttgatgatctgagttcaatccctaggacacacatggaaacaaaatacagactcccacaaattgttctctgatctccacatgcatattatattacttatgctcagaaccacaagcccctaaaccatcacacatataaatgaaaaaaactaaaatatttacctcagctgcccctcacccaaggttctgtcaaccaaaaggaaaacttgtgtgaagaaatgaaaaaatgatggaagaatatgccaccattttaagccattctgaggcataaagaacaagcacacactaataagttagactgctccaggcttgctactttcatgcttgtttataaataacagttcacacatagaaaattcttgataaatatttgttgaaattaattaaatttattcagggataaatttagtgtagcacattttcccaaggtttcatgcattaatatcaattcatgagttccacaagctctgaggctgtatctatatcgtagcaataactttccttttcatgaaaactgtcatttctcagcattcaggaggcaggggtcccctttgtacttaaagcacaatgggttttaatgctgctgttgttttgagggtcaatgaggtcttctgcctctgaagttggcttcctccctttgaagctgagctcctgttgggtggtagcatcttccttaacagccctacatattttttttcgtttctttttttctttgaattagaaacaagattggtttacatgtcaatcccagttcccactccctcccctcctcccctcccaccaccccccaactaaaaccgtaccttatcaaatatcctttctgcttcccagagagggtgagaccttccatagggagtcatcagagtctatcatatcctttggggtagggtctagggccactgccttgtgtctgggcctacatcctttttttaaaaatgtgcctcaaacctttaaggttagtgtatacctaacttactgatacagtataaactaagtgtcaaaaatacaatcacgttggccatttgcttttcttcctgggcctacatctttatacaagctaaagatcaggcatggattttgggggaatggatccagctgctatggttattctgttcctgggtgtgaagccacattattaggtcataccaggtacatagtggtttgaatgagaatggtccccacatactcatatgtttttatatttggtaccctgttggtagaactgtttgagaaggattaggaaatatgaattttgctggaggaggtgtgccactaagggaaggctttgagatttaaaaatcctaccacattcattgttctctccactgctgcatcaccttctattttcttctaaggatgtacgctctcagcagtgccattcctgccttcctctggatatgctccatgccatggactctggaattatgagcctcaaattaaatacttacattaataagttgcctttggtcatgatgttttgtatctgcaatagaaaataaataaaacaaggtagtaatcacaggagttgatattgaaactcagttattcttgttctgtactctggagttactcactcatatagaatccttcctgtctctcccttcattttctgagggttgtgtacaaaattaccttctcccattttcaggcaaacaaaaagatttgtacatacaaaggggcttcctccgtgtctcctcaccagcagtgtcctagttactacttctgctttccaacccacgtcactgaaacaaatagtgtgatttcttctatgtatttatattcagtttatatttataacatggctacaaaacatatggtcttgttttgaaaaagtttacattttatttctttgtagttatatttttccctgtgattttattgtgttatacgaagtcaaatgtctagggcttccagcaccatttctcgcttatgagcttgcagggctgttgtttaggcttggctcaaatggattagctggacttggatgcaggctcggatttgtatttggttgagatcagtgtttctttgtgtatttttccattgcagctacccatcatattctttttagggtaggtgataaaagtgtgaggattatgacagattaccccagtgtttgcaatgcctgcctagtcacatatgtacatctcagctcagagttaaagggagattgaaacactgtctactccaaaggtagatattggagagtttggagaaaaatctttggatttcactatgtattttaaggatgcaaagaagaattgagaacgtgaatccattatcttcaactgccatagtgacagtgacaaaggtgaaggtgctaatggtaattataatgtaaataagttttcatatccagctttcaccattatctttaattgttctgggacttattgtttcagttttaaaagcctaatacatttggtaagccttataagattttatttttgcccacaaacagctaaaatgcattgagaaagaaaaattttcctattgataggagatgcacacatgaatgaaggtgtgagtaccagtgaataaagaacaggtatttgtctttaaggtttacttcccctgagactaagactcatgaagctcaagacacttactaggggtagggagctcagaaagttacaagagcacaaggtccctctctaaggtcatgaatgtattatacacatgctgtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnngagagagacagagagagagagagggagagagggagagagagacagagagaggagacagagagagagagagagagagagagagagagaggatttctctgtgttggcactgactgcatattacacagagagctccagggtgaatcaccactcatgctgctggtatagactttttggccatgcagttgcctcaagtcatctgtgctcccataagtgaccacaataaactcattggtttataaagccatatctgggaggaatcactctttgatgtagtgtggatggtctttctgaggtgaacagatgtgtgtgctttcctaggaaaagtcacacaatatgtgttttcagacatgactactaaggaagaaaggacttgtgagcttaaatgattagtaagtacaaaggaatctctatctccttttaaagaaaataaaaaggctcaagagttctgtgctcaggtaacagcagtggggggttctgctttttgtgtaggaaaaacattcaactcgttattcggcaaatcatgactcatattcgtgtatcttcatcatttcatgtgattattacttgcataataaattttacctttataaatatgttggaaagatgacttttggcagttcttttgttcatgaaagaaaaatggctactcacctttcatttactttgctgagaataagataaaggaaataaagatgagtaataacttacagatcaataaaacatattgccatttggataagaatttgcccaatatgcaaaatttacttggcattgcaaacttttatctttccataatatgctatataaatgataaaatttatttgttgctttaaagatggggaaagaaaaagttacctcatcagtaccatagaagtttattccaatattttatcacctgaggggtgttccacaggctgtaaaatcctcaataaaattgtaaatatcattgaattgtctcactctgagttgaatatcaataaaactaattttcaatgagaagtgctgcctagcagaaatgggaatcactactgatttacattttcatagttgaatatcctttattaaatatcattccttatgttcactacaacttagctaccttttaatttttaacctacacattctcaggaactttctttggattataatctactcctttgctttattacattaatgaatcttgaaattaattctggacccaaatttcaaactcctgatgctccaccttagttttcctaccaggagtttaaattgagctggtaaaataaaataaaataaaataacattttccagtataatttaaaaaatatttagttattagttttctttttgaaaccatctgtaattatatcatttctcttttactttttctttccgaatcctcccataaacctttccttgatctctttaaaattcatgacctgtttttgtttagttgttgtatatatatatgatatatatatatatatatatcatatttatacatttgggtatatatacccaaatatagcaaatctataagtataatgtgctcaatctgtatgatgtgcttttatgtacaatttcagggatgactatttagtattggataaccagttgatgttctcttccttaggaaagactatcccatgttcagtatttcttagttgtctatagtcccttgttttgggtttatggcctctggggcttttcctcattcactttatcatgtctattggtttcctcgttgttcagctcatgtttgtgcaggcatgttgttgggacttgatgtatatctctttctgagtttactagaagacataatctcaaagcaaactccttttcctcttgcttttacaatctctctgtcctcttttatacaatgaatcctcaagccctaagtatggtacttgtgttatagatgtattcattgggactttcctccataactctggattttgattatttgtggttttctataattttctcactgcaaagagaagtttccttggtgagggctaaagtctattggttatttctttttctcagtattttatatgacatgcttttcttttgagaacttaatttctgttaaatacatatcattaattagtagattgtaattattagtgtagatcattagacagtagatatctttcttttactttttacatttgttcaatatacaaattttgtctataagacatcaatatcatattcctacaattccattgtagacttttaatgcattgcctctttattctcaagccctttgaaaattccttgcagatgcgtcatgcttatttttctcaccttaattcatcagcagtctatcttatgtaattttcctaacattcagtctttctgctagtctaaacctcactattttggaatccacatttaatgccattaattccagtgaattttttttgagttctgagccaagtgaatttccatatacatttatgcttctatttttatgtgaactatgaatggtcatttaaaaacactggatgtctctaatgccagatatggtattctattgcaagctgtattggaagacaaaagcaatgcttcctaaaattattcagcaactctatgtagacaccagagatccataatctattttctggtgaatatgtatttttctacatgcttgcataagtgaagaacaacttagcatcctattactgcctgagaatggaattcaggtaattgttgatagtctgctgctgtgattatttaaaaagaatttttcctgtaatggtgaaagttactaatgttcactgttaggataggagcatgcctgcaagagctctggaggttgttttcatcagagtcagaatattgtatgaaatctactcctgttgacacacttagtatatgtggctttaacagaatagttgttacacagattttgaatgacttattttgattgccattgatttggttaaatataagttttgtgtaaaatggagcgagtggttctaatttgtctttaggttctgtaaacattcagtcagcagaaaacaagccagagatatataatttatatatttaatgatttacctagggttctttcacattggctggctgtcacatcctttattagccagtcttaagcaatacatattatgtctcccatggtagctggatttgagcagagttacctcttgtatatatgtctggtgcaaaagcaaatatcaatacttcatttaaaatgacttcacatttttaaactatagtttttacaaataaatgattctatagtacatagctactgtgcttctgtttaatgaacagcaacaggataaatcatgaaactggcataacaagtggcaaaaaataaaatcagaccatggaggtaatatctatcatttaatatatcttccattgttctaaagttcctaagagaaataataaaacattttagcaatattttcatattcaatgtaattttaatcttctcagtttggaaaaggaacatcttctcgattcactagtgatgactggaattttaagttaattaattattattgttttggtcattgttgttttgagacagtgttgcacactgttaagtttggactctagatcttagctttccttcctcatcctcctgagtactgtggttgcagatatgtgtcactatttttttttgattcttttttgtagtggtaaatcatgtcacaaaataatataatttcccttttagcatggaagaattaaagaagagaggtttaatagtggaagagctgaataattcaggataaaattatataatgatatggcaatgttactttaacattattatagtgcattggctgttataacagaaaatacaattccgcacccttgtcctataaagggcttttccgaaaattatatgttactgggagattgaggagagttatgtgagatagcaagaaccaatggatagtcttactacattcaaccattactgagggtagacagtcaacttgccatgtatgggctatgatttttaaaaatcatgataatatgtgtttttgaatagccacccttttgctgatcatttagaccatttagtgaggactactgtaaagctgtgcttgtgttaaccagagctcaaatgtggttttgaaaataatattttctttactgtataataataaactttggatttgaaaacctggaaaagatttacaattgcatagagcaaaaataataatatagtctaaaatctattgataacaatctaatccatatttgctttgaatatatctatatttatgtacatggttatatacacattaaatcttgcatttcaacatacatgcgttttagcatagtatctatgcatagacataaatacacatgcattttaattatttgcttatcatataaagttgttattgagaaatttcctatctaattacttctaaagaaactattaccttaatggttgcttaatagacttgtgatagatgtactctaattcatttatccctttccttgttaggaaacaatgatgtttttcctatttccatcatcataacttctgttttaatgtagtaacttctagggaaaattgatattatacaaactattctgcagagactttcaaagttccctatttactatctatcatatgattttcataggaaaaattcttttattgtttagtttcatagttaaaacatttctaaaatccaacaattaaaaaattcttacatttttctctgcttataaaaatataccatgtaattacttaacaataaagtcactagctatttcttaagctgttggtccttttcttatttctccatctttctcctatagctattctattatttattttactttgtattaatttttaaattgaaatataattacctcaattcccatcttctctgtcctttctccaaaattttcctctttttctacccccctaaccctctcacatactctgcctcactccattttaaactgatggtcttctttttgaaggtctttgtttaggtgggaccctgtgagatttcacttttccttctttgcattcatattatcatattatcactttgaaggtcctctttaggcagccatattctttccatacctcaacaatatagttattacttttgcttgtacaatatttttgattaatatgttctttccaaagatttgtttacacatgcattttttgttttagcttcaccaaactttgaacaatatcccaaatgtatatttattcatctcttgttagccttacttcaggaattccattattttgaagacatcatcaaattatgctacatgatctgagcctatttttgtttacacataaatcttatcattggtaaatgacccatgaatcatactatattataaatttatgctcctgatgcttaaatgaagctgttaacatcactatgatagttagtaatgttcatgggcaatttcaataactgtaccaaatactatgaagaacatctctttacagcatgtatttatataagcaatatgatataaatgtatcatttagattaatcttcaaatctataatattggtatacttctttccacaaataaatcaggtaacttcctcatatactaaataagttgctaatacctatgcgactataatgcagtccaaataccacaaaccaaattcatttttaagcagttcctatatttttttcttaataaccaatttcaaatttaagatataagttctgaatgaattttgcaataccttgtgagaagctgtttcacaatgtgaacctgaaacacagttggcagttcccttgtggttcccttgtagatctttgtggttccttaactggttgccagtcttacgtggtattaagtatgttttcatcaattgccctgttcttcccagctttcacccaaaggaaactgtagagtgcactgccatcataaactcttatcacaatgaatatgtaatggtttattttgaagtcacatattattgaccatgaaacagaagttcacattcaggttacctaaatcacatattccagtgtggtaagagtttaaagtttttatagaaacagagtaaatacaatttaaaaatcagaacattacttaaacatactggtagatatatcaggtaggcaagttccagaaaagcaggaggaccatagctatatggccgtgttatcatctgaattctggcaaacctttgggcttgaagaagccagtgtcctgtttgtacattccaaaggatgtacttgtttccctacttaatctgtttgttggtctatctgcctccatctctgctttatgataaataacattcctaccagggaggatgtggtatctagtttcttgattgaaaaaattcacatgattcttttggaataccccatggctcccattcaagtttttctctcctatcatagaagtatacaacacaaattcaattccccccaattcaattttttaaatgctgggcaaatttctcctctaaggtagaaatccaaagctgatgtcctaaactacagcatcctagttgttgagattgtaagctttgactatatatgtgaatacagtccttgcaaatcagtaccttaggagttccttttttttttattagttcaaattaggaacaagcttgcttcacatgtcaatccctactccctttcccactcccttcccttccctccaaccctccccctggccctctacctcaatcacccttcactccccaggcagggtagggccctcgacagggcctccacaaagtccaccacatcatcctgggccaggcctaggccctaccccatgtgtccaggcctagagtgtatcccttcaaatgggatgggctctcaaagacccttcttacaccaggaaaaaatactaatccactaccagggcccccgctagagtgcggaggcctcctaattgacatccgtgttcaggggtctggttcagtcttgtactggccttccaggcagcggtctggggtccatgtgctcccccttttacaggccaactgtttgtctggttttcaccagcctcatactgactcttttgatcttcgttcctacctctttgcaacaaagtttcagagttcagttcagtgtatatctgtgggtgtctgcctctgcttccatcagccactggatgcggactctaggatggcataaaaagcagtcattagtctcactataggggaagggcatttaggctatcatctccaccattgcctagattgtcagtttgttcatcattgtaggtctcgggaaatctccctagtgccagatctctcttcagacctataatggctccttctaatatggtatctctcattctgttctcctctattctttacccaactcaatattactgctccttcattttttcctctcctctcctcttctcctctcattctggcagctccctctccccctaccctcatgctctcaattagctcaggtgttggtgccacttcccattcctggggtccatgcattttcccttagagtcattctcgtttccaagtttctttggtgaagaggactgtaggctggtaatcctttgctctatgtctaaaatttatatatgagtgagtacataccatgtttgtctttttgtgactgagttacctcactcaggatggtttattctagttccatccatttgcctggggatttcaagattccattgcttttttctgctgagtagtactccattgtataaatgtaccacattttctccatccattcttcagttgaggggcatctaggttgcttccaggttttccagattacaaacaaagctgctatgaacatggttgaacatatgtccttgttgtataaacaaggattatttgggtatatgttcaagagtggatttgctggatcttgaggtagactgattcctatttttctgagcaaccgccatactgatttccaaagtagtcttacaagtttgcactcccaccagctatggaggagtgtgtcttttgctccaaatcctctccagcatagattttcattggtgttttttatttcagcaattctgtctggtgtaagatggtatctcagagttgttttgagttgcagttctctgattgccaagaattttgagcactttcttaagtgtctttcagccatttcagattcctctgttgagaattctctatttagttctgcaccccactttttaatttcattgtttggtgttttggtggctagcttcttgagttcattatatattctgccagatgtggggttggtgaagatcttttcccattctgtgggatgtcagtttgtcttactgaatgtgtcctttcccttacagaagcttctcagtttcaggaggtctcatttattaattgtatatctcaatgtctgtgctactggtgtaatgttcaggaatctgtctcctgtgccaatttgtttctcttgtaggaggttcagtgtggcagaatttatgttgagatctttgatccatttggacttaagttttgtgcattgtgacagatatggatctatctgcaaccttctgcatgtccaaattcagttataccaacaccacttgttgaacatactaattttttccattgtatagatttagcatctgtgtcaaaaataaggtgtttataggtgtggggattaatatcagggttttcaatttgattccattggtctgtctgtctatttttgtgccaacaccaagctgttttcagaactatggctcgataatagagcttgaagtcagggatggtgatgcctccagaagatcctttattgtacagagttattttggctatcttggtttgttttccatattaagttgaatattgtattttcaaggtctgtaaagaactgtgttgggattttgatgggcattgcattgactctatagattagttttggcaagattgctatttttactattttgattctacctatccaagagcatgggagatctttccattttctggtatcttctttaatttctttctttaaagattcaaagttcttactgtacatagaggtcttttacttctttgtttagtgttatctcaagatattttgtgttgcttgtggatattgtgaagggtgatgtttctctgatttttttctcattgaatttatcatctgtatatagtagggctactgattttttgggggggattaattttgtatccttctactttgctgaaggtgtttatcagctgtagaagtttcccggtagagttggggttatttatgtaaacaatcatataatttgcaaacagtgaaagtttgacttcttcttttccaatttatatccctttgatctcctatttttgtcttattgctctagctagaacttcaagtataatattgaagagatatggagagactggacagccttgtcttgttcctgattttagaggaatcgctttgagtttctctccatttagtttgatgttggctgttggtttggtgtatattgtttttatcatggttggatatattcctgttattctgttctctccaagatctttatcatgaaggaatgttgaattttgtcaaaggttttttcagcatctagtgagatgatcatgtggtttttctttttcagtttgtttatatggtggattacattgatggattttcgtatgttgaaccatccttgcatccctgggatcaagcctacttgatcataatggataatttttctgttgtgttcttggattctattcaccaatatacttttgagtatttttgcatcaatgttcatgagggatagtggtctgtcgttctcttttttagttgtatatttgtgtggcttgggtatcaaagtgattgtagcctcgtagaaagagtttggcaatgtcccttttgcttttattgtgtggaacaatttgaggagtactggcattagctcttgtttgaatttctggtagaattctgcagtgaagccatctggccctggcctttttttggttggaaggattagatgactgcttctatttcattaggggttacagttcgatttaaactgcttctctgttcttggcttaattttggtaagtgattgatgggaatgtactatttatttttattttgttgattattgaataaaatactgatggggaatgtactactgtgtatgtttatcttattgattattgaataaaatactgtttggccaatgagacagcaagttagacggaagtaggagtcaaagaggattctgggaaacgtagtagagaagatgaaccaggcaagaagtgacatagcaaggagactcatatttaagctaaagaaaaacaggaagggccctctttccccttcagctcctgcttcagcggcacgatgtgatcaccagctaggagggacgccaataaggcgtccgataagataagtcttataaaatatatagatgtatgataattgagactgagctaacagatgagaatcctagtcattggccaagcagcagtgtacctaatacaagtttctgtgtatgcatttgggcttaactcaggcacgcagctggtgtaaagctcacacgtggcagtggggctcaggtggcttttggcagaaagatttatcttaacaagtgatatctatccagaagattgtccctttccttttggctttcgaattttgtggagtacaaattttcaaagtatgacctggatttacccagattctcttgttatatctgcctttttgtttctgattttttaaatagcatgctctctctctgccttttggttagtttggatagaggtttatccatcttgttaatcttctcaaagaactaaatcttcgtttcattgattctttgtaatgttttcctagtttctactttattgattttagccctcattttgattatttcctggcatctattcctccaggattagtttgcttcatttttttgctctaaagctttcagttgttctgtcaattctctagtgtgactattctccagtttcttcatgtgggcacttagtgctatgaaatttcctcttagcactgctttgagagtgtcccataagtttgggtatgttgtgtctacattcccatcaaattctaggaagtctttaatttcattttgttatttcttcctagacccaggaatggtgcaattgggtgttattcaatttctatgaatttgtaggttttctgcaatttgtattgctgttgaattctaagtttaaagcatggtgatctgataagatacaaggggttatttcaattcttttgtatctgtggatgtttgctttgttgccaactatgtggtcaattttagagaaggttccatgtggtgctgagaagaaggtatattcttttgtgttttgacggaatgttctatagatatctgttaagccaagttgggtcatatcttctgttagatcctttgtttcttcgttaagtttttgtctggtggtcctgtctagtggtgaaagtgaggggttgaagtttcctactataagtgtgtgtggttttgtgtgtggtttgagctttagtgatgtttcttttacaaatgtgtgtgcctttgtatttggggcatagatgttcaggattgagatttcatcttgatggacttttcctgtgataagtatgaaatgcccttcttcatctcttttgattgattttagtttgaagtctaaattgttagatgttagtgttgctacaccagcttgtttcttgggcccattttattggaatatcttttcccaacccttaactctgaggtaacacctgtctttgaagttgaggtgtatttcttgtacacagcagaaggatggattctgtctacataactattttgttagcctgtatctttttatgggcatgttatgaccattgatattgagggatattaatgttcattgattgttggttcttgtttgtttgggatttattgttggtggtgtcattgtgtgtgtagtttgccctcctgtttcttttcatgtttggtataattggattatctattgactatgtttttgtgagtgtaattatcttccttggtttgcagttttccttccagaactttctatagtgctcgatttgtggatatgtattgtttaagtctggttttgtcatggaatatcttgttttctctatctatagtgattgaaagttttgctgagtacagtagtctgagttggcacccatgctcctttagtgtttgtgggatatctatccaagaccttccggctttcaaagtttccattgagaatttggatttgattttgataggtctgcctttatatgtttcttggccttttcccttgctgcggttaatattttctctttattctgtacatttggtgttttgattattatgtggcaagtagactttttttgtggtccaatctgtttggtgtcctgtatgattcttgtaatttcataggcatatccttctgtgggttggggaagttttattctatgactttgttgaatatgttttctgcacctttgagctgtattcttcttcttctatacttattattcttaggtttagccttttcatggtgtcccatatttcctggatattttttgttagggagttgttggacttttgatcttctttagtcgatgaatgtcgagtgttcaacaactgagattctctcttatatctcttgaattctattggttatgctcacatctttagttcctgatcgtttatccagcctttctatttccagcatcccctccttctgagttttctttattgtatctgtttcagctttcatgccttgaactgttttgtgtgcttcctttacttgtttggttgttttattgttggctttctttagattctttaagagatttgtttacttcttgaattttttggtttgtcttttcctccttttcatgtaattttttacttgtttttttttcttctatttctttaagggattttcttgtttcctctttaaagtactctatcatcttcctaagataatttttgaggtccatctcttcttcatcttctgtattgggcttttcagatcttgctggtttgtagtccctagaatatggtggtgtcatattagtctttctgatgttgcgtgtgttcttattctgtcttcttcccatatctccttccagtgggtgcaggtcaggtctctctatctcctcttttcaccaggtggtgtgtgtgggccaagacttcaatgtctgcagctctggaaggtcttgcatctcctggtagtctcctcatttagataggagtcagccagcatagggggaaggaattgtgaggtgtttcctgacccagggagctcctccctggctgggctggtccactccaagcagatgcaggcccagagagatccaggatgaatgggatttgggtgcaggagtagggtgagagcagagggtacactcacctctgtaggggtcaggccagcggagggggaaggcaaatgtatcaggaaaggctaagttctttaacctttcttatatttaatttaatcatatttaaaatagaaaagctggaaaatcagctgcatttcatacacaatctccaaaagaagtttaatttcatatcattaagcaattgaggaaaagtaagcaagaagaaagaagcaaagccataagtgaaggaagaatgctgcttttcggacacactccatacacagggacagccactttgccttcctatcaatatgcaatcagtgtgatggatttcaagtttattagtcagagataattattacatttgtaagtaaaaagtgcattaaattgtcattaaccttgtcaaattgctaaatttgaaaaacgctactacaattttcattttaaaaaatcaggttatttctcaggctccttctctcattctgtctcttccaagctggttgttgaactgcttattacctttttaattctgcatctttgtttcatagcacatcctcatttgcatttctaaaatcagatgttcctttcacataccacagtatcctaattaaaatattaaaaggcgcgttttgaatgaagagaatttacattgccatatgaaatgcttagagtgctgcagggtgctcctttatgtttcaaggatgctttctccctaagttatttctagatgttcagttattaaccctccccgagtttcagggtagatgaaaagaaatgtaggaagaacagaaaacaggtatgtaaaaacgatgcctttgcaatgattcttggtgggatttatttattattattatttgttgtagaaaaattcttgctttgtgctcaccttgaactctcaatcctcttgcctctgtttcttaggtgctgggattgtaagtaggtaccagcacaactgagtccccacactcagcttaaactgattcccacaatgtgttcagtgtcctgtttagtttgggaatcacacaaagagcaatgctggacacagttttggctcagagtacactgttcttctgaatctccataaatctcttcctttgttatattttattatgctttcttttcttggtctttataatgttcccattaaagtttcctgatacatttgccaaaccacttttaatgctcataaacaccttccaggtctgggggtccatgagtatatcaacctaatcaaagggtgactaattctacttcctgatatctttatagccctaaggttgaggtctgagtattactgctgaatatactaccagtgtgtggctttcactagcattcaatttattttactcattcctaccttaggaatacacatctttctttaacttactgtgcctatatacagcaccttgataagcatacttgcacaaccatgtgaaaatgtacaagcagagtttcatcaaacttacctccatacaacatggctgaaaagcaaatgctctggatacctaagaggaaggaattgtaagttttcatggaccatactggaggctatggctaacaccttcaaagctcttgcttcaagaccttagaatgtgtgtgtataggggtatgaaaaaagtttttgtgggaaggaaaagtggaacttagctaacaagaatacctattgactaggctatcatccttcccccctctatcttagcctagactattatagtggatggtgactacctgatatttgttactgtagttctttacaaaagctaaatactattctgcaaagtgaaagtacacagaactgtgtttgctttgggttagtttaagtactgcttcaaaagaacaaggagagcgcttcctcattctggcattctctgggttctgcaaatccaaggagcaatctttttagaatttaagaattctggagaagagagggaaccttttgaatacttgaaaaatgattaggaagaggaaataaacttctggataagagagaaagggaacatcaaagtaactcttccaaggatcagttccaaaaaggtggccacagttacagtgactcatcaagcacacacatctttaattaatacaaatttttgtaacggctgaaacatttcatttgttgtggggttatatttctgtcttcttcagaagtacattgtgccagtcctcttttcaatattgttattttaaaggaaagnnnnnnnnnnggaggactggacactctatggggccatagtcacattggagattgtaaaggttaaatttggacaaacattcacatgattcatgcaggtttcataacatttgatctcttgagctattctttacactaacaaagaaatcacatacactctgtgaaagatcaatagacaatagatagataatagataaacacttagaaatgtggctatttatataatttgactgctactgctgttattatcaatattattatttcttaggatgttcataaaggttagatttctgtctcttatagatcttcatgcatagaaatagtacctttgcatgttggagtatagtagaagtgttgacttttactatattcctataaaacattggatttaatcatgatgtatcatttcattcttcatatgtcaaggtattcattttctctgatgtgtttctctattataggtgtataaatccagaaatatcacccaccaaaggcaatatagcaaaaagaaaatcataaatcaaaacctagtttctactccctcatgctaacctgtccatctacgcctaagggtacttggtcatagtgctctggcagagattttccataggatttactctagtgatgcagttttcttgtttgaatctataatatttccagtacctgtctatgggagggaataagtaactttcttttaatcaacttctaatttatagagaactcaagactctgaatgactgtcaattctttcttggagtacaagtattaacatgtaagaagcattttgattggactagagagtaaacctcattttaatataaatggaaatttgagatatttttgtaattaaaattatattactaatgtatggaccttgataaattcctaggaatatttaagcaaccaataagtcttctataagaaattacagagcattgtggattcaaaaagtcttgtaggttatcagcttttggtaaactagatgttctcatgtaatttcctgtagtactaaatgaggactaattagtaaagcctttgtggaatgcaatgaagaattccccctctcaaaattaaatatgcttccatatgagcaatggttctcactactatgtggatgaaatgaacagagtcactacactgagtaagtacccacaccgtcatgtacacaccagcgcagagataaaattaaaggaagtataataagaaatcctcattgccaacttgactttgcagcatgtttctagacaagtcttatgagggtgtttcagaaatgtgtaatcattcactcaaaatgaggatctcatttcattccgtggaatcatagtctgaataaaaaggaaagcacaaaccgtgtaccaatattatttgcttctttactatggatacaacgtgaccatctgcctcatgatcctggtgctgtgccacccaccaccatgttatcatatggaccacaataaatcttactttccttccttcctgaatcttgcttttctcatttactatgtcccatctgtgagaaaaacaaccagtactctaatcactcataaactgacacatggataaagacaatgtgatagtgtgatgcattacaaagtagaatactattcacctatgaaaagaataaagtcttgctatgggtgaccacacagatgggttgaaaaatactatgttaaatgaaataagcagaattgtgagatctgaaaagtttgacctcatagaaattgagagaacaatggtattgtctagaaagtataggtggggagacaggactaagaaaatatggtgaacaggtaataaattactggtagatagaataatttctaatgtgttgtattggagagtgaaagataacatttcagaagagctcaaagagacaatattaagtagtttatccataaagaaccaggcaaatgaatgaacacaagttctaaattaacatttgttttaatgtaatgataagcttcaagtatgagtgagaattcaaattcttctatatccttcttattatttgtctccttctgagcttccccctgagttgaagcagaggttagaactgtgtgaagaggtgagattactctggggagagctagttctgtgaactgtaactgatcttttaattactgtgaacctatctgtggagaggaagaatcccatatcagaggtgatgattgtttcttagaagctccaaaccttctctggaagaaatcatggccatttaggtggccagtaattttataattaaaaacaatatgtgtaacaataagtctgtactctaaagccatcagagccctgccgccacgtgggtgttttctgccagccgcctgagttctgctgctgaattagggtcccaaatagtttagagagacttatattaggtacaaatgctgcttgccaatgactaggatttctcatctgctagctcaatcttaactatcataaatctatatattttataaaatttatcttattgaggacacctcccactggtgctctttcttgccagcggatcacatggcaactctagaacagagaccaggaggaagagcaagagaaaaagggtgacttccttcttgcccttgcttatatatgagtctgcctgctatgtcacttccttcctgtatcactagacttccttttcctacatttctcagaatcctcctcgacacctagtcctgtctaacttgctgcctcattggccaaacagtactttattcaacaaccaataagaagaacataccgaaaagggcattcattccccatcaaatatgttgtagacatggtaattaagacaacaatggcaaataaagttccatgagcaagtaaggtgtttgtgacttgctcagtgttgccctacaggcttgcacatttgggtacttggtttgcagtcaatgggctttggtgaagcaattagagttttagaattaagacctgatcagtgaattgatttcttagtggattcctaatgtgatggcttctttgggaggaggtctgggtggggtctgattagcagaaggcattgtctagagagatttcctttctcttgtcccttgtattcttcatgcctcctgtctaccaagaggtaagcagcttctgccacattctcccacttacacggtgttttctcacttccctaaaataatagaaccagtcaaccatgtgtgggaatatctgaaaacatcaatcaaaacacacctttctttctgagtatgggtaatctaaggtgtctgacagaaagtctaacacataaaggaagacaggaacatatatgtgctagcaaaacaatgaatatgcagccatccatgtcagattatgggagctctaagaaacaggttgcaaaatagttaccaatgaaattcatagatatttcatttaagtcatgaaataaatgcctgctggagaatagcagtcagtgtgaaaaaaagtaatcagaacttctgagagaaaaaaaaaaaaaaaacatggctacacaagaaggaaggaaggaaaggaagaaggaaggagatcccaggagcacagataccaagctgtcttacacatgaagtactacatgactgaaaacttttttgaagatatcttccagaattcagcccagaattgctgatggacaatgtgaattcaaaactaaaagaatttgtaacaagaagtgattatgctttctgcatctttatataataccagagatttagaatggtgagaactgaagatggacaataccattgagcacagtcaattggaattttcaaaatagatgcaatagggaagacaagactgggagagtatcaacagaggggctttgttcttaagattatgcacaagcaaagcaaatgttgggcactctgaaatgatcagtagaaagtttgtcataccacttaaggaagaaatagaaatgaggcatggaggatagaaaaccaaatgaaaatttggatttgtaaaaaatagcttaacatctctttatgagtgaaatttatccaaaaatctgaatatatgtatgaaactgtcattcctgacctcaccagcacaaaggtgagcacactgaaaattaataaacttcctaatattaatcagaaaattgtggtcccaagatacataacctaactgctttgtggagagacagtccctatgatggactcacagcctaggtcaggcaccctgaagcagaatgcctggggtttgaggctggagggaatgccttacttgtagtcttcatgatgttctggattctgatactgattccccgggaatctcaggagaggaagagtaactatttccagacacttataagtggaagtccttccctagatcctactctgacataaggatagaacacatagccatctgtaatgttcctactttgtggaagagattgggataaacaaacaaaataatgggttctaaaattcacagcccagtcatgatgattgatttctgaaactccatcactgactgagccacctcacaaaccttgtaaaaactaattctccttgcaatattaatatgtacatttttaaattttaatcagaagtttaatatgatctaagcatggcagcacatgctggtcttctctgcacaagggaaaaagaatcaataggatcagaagttctaggcaactttggctaaattgataatttgagtctatctgggctacataagatcctgtctcataaacaaagcaataaaacaaataaagaaaagcaaacacttagtttgtgagatatttcaatttatccatcaatattctaaaatttatgtatatttttatgtgagaagtaacaaagataagtgagaaatgagttgtttaaaagttttatcaaaaatagctcccacacactagagtttattagaggaagagagaaaggagtcatgaaaacaatggttacttattgttttagacagagacagtggaagctgctggggataggctgtgaggttgacctgaattcagcatgctgttgctgcaacacatcctctggttaaagtgtgtgtgtgtgtgtgcacatgcatggcttcacacttgtgcccatgagtatgtgtctggagcattgcacctaacaccttcaatagatcatttgggggcttcttcctattcatattcatgtcttgattcttcataaataccctgaagtgttgtctttgtgcataaattattaatttatattcccttatttattattttactatacagaaccctgatttattttcccatcacagaagctattttcatgctttataatttgaaacgtgcagaaatataaggaagaaaatcacagttgtcacttgtggtctactttccccttacaatccagaagattttaaaatacacttattgttttctctccccaatcttaccctggctctgtgatttagattgatttcagaggcttgaaattcctttcctactgtttagaacatgtctctgtaagtatctgaatcatgtcttgccctgggttcccactcaagttgtcaacctggtggactgccaaccctaggaaatcttgtctccccttccactgcattcctagcaactgagaactgcatacacagtagggcagatgagtgtgcagtctgtgaacacaataggactaatgaaggcatagtttgtatgtcaacaatggtgctaaagtgtagttacttctctaattagcacagtggtacatttctgctcattacagtatttactctttacgtactttatgttgttcaccagctgtttatttcataaaaataaatttcaagatggtcaggctcttggacttgtttttttatcgcgactataaacagggttcttagcagcacaatctctatccattgttgcagcagaaacttttctctttacttccataaactgcaactaaatctctgtaaaagaaacagaagcaaaccctaatttaaagacaaatgagtgtggcaattctaatactacagatcctcaaacttctttgtgtttctttatttggtttattggtgttggtttatttttaacttaataataccatagtacacaccaccagaccctttccttttctaaaaaagcacccttgttctagttaaatttaaaaatcataatcattttctgacttaaattgctatgttgaatgaggttgcaataagcaaatcatgaagaaaagtttgcatttgtcagaatgcttctctacatgatttatggtttgacaatgctcaggaacacacctacaagtattattaacaagattgtgaggtattgaggtctctgatgcatggaaagaacatctaagtaaactaaaatttactgcagactacagtcaaagctcttaataaagattgggtaaatgcgtggaggaactgattataatttccatgtgtgcatcttcttagtacagagtggtgtctggaacaggtaggtccagtggagtcttggctaaagctttactgtctgagaaaagttacaagtgttatattttaaaaataattttttagaatgaatcatacagcaagaacaacatctttactcttcccactgaaaaaggcagttaattagatttattttctatattagctgatgatagacaaaatgaattcataattgagctttttaatcttaatatataaaagttcaaaactaagttactctatttatagttatcaaatctctatatatgttttgagtattaccttttgattaaatttaaaatctgtttgaaaaatgtaaatcaataatggacaaatcagaaaggagttgctgtacagttcagttataatcattacttgagagagcatgagtaagttacctaaaatacaagtttcatttttttcaaagtaaagtaattctttcacttttgagttctgagtctttgtataaatatttttacctgaacataacaaaaaatttccttcagtagtatcttcaaagtaaggacagatcaaaggatcagaccataaatcaaatcaagcaacacctcaaaaaatcactcttattttcactgtagttcaaaacaattcaataaatattatctcctcaacttcattatgatagagccataatttgataatggccctttctcaggcttactctgaagagagccttaaacaggactgcacagtcagtctgtgttgtttccaacagtgaaaatggacaattctggtggtatcaaaatgatcaaaaagaagatataatggaaaccttgtaaagccctctgcacctctccatcttggtgctacccactgcactggatggatgttctgctgtttcaagaccctccaaaagaaggatcagtgcctacactttcttagtttctccagcactgagaaccaattcctgtctgctttaaagtaacatgttagaagaacacagatgactgaagttagagagagaagaaaagagaggcagaggtaggtagaaagaaagacagagatatacaaacacacacgtgcacacacacacagaaaggttggaggggacggggaattatagataaagatagacataggcagacacaaatagacaggtggagagatatagagattttgattcactctgccaaggacaagatagaactttgtcttgtggttcaatttgttattagtaaagcctgaaaaggactccagaatggattatctaataacattgatcctggcatttcctttcctttgtaaaattgcatgtatttgcttctgaattataataataataataataataataataataataataataccaaagtagaaaaacttctaacttttagtttccttttaaaatgtaaacatgtttggctagtatgatatattcataagtagaaaaattgccattgcactattttaaataaataacacaaagccctaaagaaagcagatgttgcaatatgaaatgcctgctgttttcacatttgttaaagaaaatatacttggattactataattggactaagatcttttactaaagtaggagattccttttgctctccaagctaaaccaaaacaccctatatgaaaatgctgtccaatttttacattcattatacatgcttgccagttaaattataccattcaggttcagtgccaaacacagaaattcaggagagatgaggaaattttgtcatttggaaatgtagaagacctagaaaaacacagtactgaataaaataaagaaaataacctgaaacagacttccacaaacactacacaattactcatgtgtgtgtagcaactagaaatgctaaatgggtaagagcaaggaatcagggctttggttacagtgggtgggtcaactgtgagacatttttcacagggtgcagattttcagttaagtcttgtgggaagaatgggtggagatccattaggaagcctgatcactgtcattgatgatattagatgctatactcaaagttcagtcaggaatttcagggactttcaccacaaaaaggagaaggaaggagaaggagaaaaagaaggaatgacagaggtgatgaggaagacagggaggaaaaggaggagaaagaagatggtaacaagtagacaagaaggaggaagtggaaagagaggaaggagttaaggaagaaaaggaagggaagaaggagccctggggaggaagaggaacatgggtagaaagaacttggggttggaggagattgaaaggtaattgcacaagaagtagttatgctaatttggtatcccatgcactatagtaaccagacagtaattgtttcgataggtatatgatcaaaacattatactgtatactttacatatacaccattatactttacaaaccatttaaatgacaaaggaaaataggcaaaaaatggtgataggaccagagaactaatgggtcatcactgataaaatataagctgctcctaatctctctacctgaaaagattctcgagaaatgtggattattgttaggctcgggacaagcattaactctcaagtaaggttttcactgtgagatgactggggactctaacagaagggaatgcaggtgcatagactggagcaaatgaccttacatggtaaacaagaacttgttacatatctgctgggatgtgacagtcataaaatctgctctattggttatggcatggtgctaatgagactaaggttgaggactccctgttgacttcagggtcagtcaagtgtgttctttagtaatctctgatgacaagaaaggcttggcaagcacatatgctgctgagccagaatgcataggtattgtaggtgatccaaatctcaccatctctgctggtctttcactctgaagacacaaatgtcccagttgctcttgtagcagactctgtacatgtgtgcatattggtgtgaaccaatcctgaatgccttcacattttttgttgataccttctttactctgttattgagttgtgttgacattcaacatcatgttgatatatcttatatgcaaactctattgcaagtcatttaactttaactgaaaattttttcttctgaaaagttaacttttaagtgattaaaagaaaatactgatacatataagtttttaatcttaaaattattacattaggcaaaattgcagtgtatgctgaacaaaaatccagtcatagaataattccttttagatgatttgtttgaatacaaagaccattctcctatatagtttattatttgtaaataaccatttatttctgttactaacactgttggaaaaaaccatggtaactggggagctgtgttagttttctaatttctgagacaaaatactcaacaagaggtgcttaaagaatgatctgttttagttcacattcccagaatccagtttatcttggtggtgaaggcatgatggtagtaatgtaaggcagagggacacattcacactgcatcttgtcagaaggcagaatggtgggtaccatggttggcattccttctttattcagtctgggtccccaggccatggaatggtgacacccttagttaagggtgtgttctcccatttcagttaacctaatctagagactcccttagggaaaagaaacaggcttatctcctaggtcattctcgatcttgtcaaggtgataaaattaacacacccactgaatactgacctattcgggagatgtagttgccaggcataagagtagaagctttctcagtgccatcctattaattagttttattaatttacatactcttgtatatgtaagtgtgtgtgtgtgtgtgtgtgtgtgtgtgtgtgtgtgcgcgcatgcgcgcccacacacgcatgcatgcatgcatgcgcgcatactattaacacatgagtattcagaagatgcctcttgcagtcagttctattctcctaccatgtgtgtggcaattgaactcaggtcatcagactcagcagcaggtgcctttacctcatgagccatttcaccagccttgacactctcattttcttatcaggggtgttggatacctgggtatacatcacatgctgccctggttcttctaccagcagaattactgccttgcaaagtcactctcactatactgcttcttagttcctctcttgctgccctctacttcaccacatttatctgtggtgaggtaccttgaacccatgagtcagtgatagtggatggtatttgtcttcagatgatacttcagcagatgaggaggaatctacagctaccaagattctttgcccctttatggaatggaattcttcaacacacacctgtgtaggatgagatctcctgggcatctgaatgtgtagataatggaaaagaggctgagaatccacaactacctggtggattttacttgagaataaattcatcaagggcagaagaagtagtttcaccagcacctttgtaaggtaacattgcatagtagaaggataactcaatagcagtcccttttgtaacattacataaaaaagcatttaatatttaagtaaaaatgctgttactaccttaacttgtttcaataaatactaaccagaagtatacacttccagatacttttgtttgtccctctttgttcataagcagacttgggtttgtatgggctaaacaagcattttacaactgagctatactcctagtctcaatgtttcttattttagcctgggttttggggtcagttgtgatatatcagtaacagactctataatacagagtactgtaaacaacatgtctgtgtgataaaactgccttagaaaacaaatgaactaaaagtggtccagcagagcctgagaatagcaagatctctgagtatagtgagattctgtggctctgtaaaaaaaggtagcttcagtgaaaatataaagaattggcttttataggaagtgctaaagtttaatgaaatttaacctctttccccaaacttctggctactctgtagtctagacaagtgactgaaaagcagagatttgtgaaggatgtgtcaaagtgagatgagaacttaatgagcctttagctagtagcttctagacagtggagggcaaggaagaagttattcctttggcttttagtttatttcccaattaggaagcattcatcgtgagacttcctctccagatggccaatctggcattcctatggacactgtgagtaggagggccatgagctggatgatatattttactctatattgaagcatcctgaaagtgttttatctttgagaataaattcatcaaactgcaagggttttggccaagcttcagataacaggtaagcatccctgaagaaagtgaaagttctttgtcacagacatagacagcagcatatgttcaagggcatgctgctttgcagactcaggtaagaccaaggcagtgacaatctccaggaagttgaagaaaacacaacagtaccattagtagaagctagtggttagagattttagaagtcaagccaggcatgttttcaactctggaaagatgtaatccaatcatcatagttaattcatcatttaaaataaaacataattaatattgagtttagcttttttgtaactttttttggtaaatctcatacaaaaattttagttctctaatttttttaaattggagtttacagaattctgaaaactgctataaactatgcttttttaattttatttttatttactttagaagcaatcttattttacatattaattgcagttccctctccctcctgacctcccattccctccaccgatcccccatcccacccccagaacacaagtattactctagaattgttgaaagaagaggatccatgaaatttcactttccactttgtgtgcattctctcaaattgattttatttttcagtatgaaaatcaactgtgccccccatacacccatggtacactatatttgctgtccttttcccagattctgacatagtgttacagaacttcaccgaaaacttgttaaaagaacacaattcaaagttgtttagtggtaaactaaattcagggttcaaaaccgcccagttctactttaaatacatttgttagaatataaatttgtaagaagaatttctgagtttcttaaaattgaggcttatgatggggtttgtctttatggtagtcaataccaattttcatgacaactgacttgggtgttttgaaatactctcttctaaaatcaaagcataagggaaggtagtagtagaaaagtgggcagaggaagaggaggaggaagaaaagcaagggagggagggagaagaggaaggggaggaaggatttctttagtggtggaaggtttgtttttctctagttctaaaaaactttctaatgagcagtgactgggttttctcagtgagacacagggactagtttgtcaggactcaaccacatacttttgagaagctccgctgggccctagcctgattcctttaaatggcaatattgatcctttcttcttgaatacaggtagaggtaattacaaattaatcaaaatgattaacctctgaaatccttttgcctatgaatcactttaacagatgtcaatgggcagcccagggggactattttaggtcaggttttattcaatgctaaaattacacaggaagttaaagcttgaaatacactcacctaaaatattggactacttttcggtttagaatattgaaaatatcaacagtcttccttcattgcacacaggagacattaataacataaatttggcactttaaataatagttgttattcttaatataagaatatagacacgtggtttctttctaaaaaaatcttatcacagaagattctttttttgccattttaatattttttttattaattcaagttagggaacaagcttgtttcacatgtaagtcccttctccctctccctcccctcacccccatccctccttccccacccccaacctacccctcaccccatccacccaccactccccaggcagggtagggacctcaacgggggctctgcaaagtccaccaaatcttcctgtactgggcctgggcccttccccatgtgtacaaggccagagtgtatcccttcacatggatgggctctcaaagtcccttcttataccagggaaaaatgctaatccacttccagaggctccctggagtgcagaggcctccttattgacatccatattcagggggctacatcagtcttgtactggcctcccagatagcatttggggtcgatgtgctctcccttgttcaggccaactgttcctgtgggcaaggaaagggactgtctcttaatcttgcttacaaatgacacatgcactcatatttgcagtgtgcatgattttaatgaaatagaatatgactttggacaattataccctatactactctctagaatacttagaaaatcctcatatttgagtttatgcagttaaaatgcttaacttgagaaattattgccatcaaatgacttgaatgacccttagaaattcctcagacacagatgaagcaaagcttttaagggcaaggtttctgtttttagcattaacttcagccctaccaaggagcccgtgggctagctcattatgtagtctgctttacagtctcctctgttcttccccctactcaatatctctgctcctccatttcctctcctctactcgtcttcttgtgctcttattgtggctgcattttttattatttatttatacatttttatgttcactggtattttgtgtgcatttctatttgtgtgagagtatagaatcccccggaactcgagttacagagagtatgagctgccatgtgggtactaggaactgtaccctggtcctttggaagagcagccagtgctcttaatcactgagccatctctccagccccattcttaaaaatgagtctttggcaggcagctggacttacttctccttgaccctgttgatgtgaattccatcccttgcccaacatgataggaggaaaaaactgactcctgtaaatcaatggacacatgagctgaggttggtttgagttttcaatccttaaggaaattagccattttcaaacaacaactgtggatagtacatgatctgctggaaatctcagaaaataattcatgtagtgaattattttaacctcctctgggttaaaattccatcccagttagaagctctttaagattttgggagttcaaaagggaggcaatgtgagcttcaaaagtaaacaactcagatgtctcaggaagtccttgaaactgacctaaagtaaaatagcctttgctctccaagtttgtataagcagcatgactgctcacgagacagacaagtggaggttccccagagtctcagacaagttatgcagcctgatatggcactgtgtagcttcacaaactgttcctaaatgtacagtgagattcagcgttagagcttttgtgatccaccgctcatgccagagtgggctttcagtggtgtagctgcctttgtgccccactcctgtaaggaaacccggtatgttcactgtttaaccaagctggactttggtggtatcttcactttgtctcccctttgttattctctgtaaggacttttgataggcgtttgtttgcatctccccaggaagaaagttacaaaacggttgatctcacataccccattgaatgtgcttctctcttgaagtctttcagtgatttggtttactgttatttcttcaactatatgttgttgtatggtttcctagtagccatggagtatcaatcagtttggcagtaatataattattagtgctcctgaaattcatacgttgaagtttactttctagagttacaacatgaagagagcctttaatctcagcacttgggtggtggaggcaggcagctctctgtttgttcaaggccagcctggtctacagagtgagttccaggaaggactccaaggctacaaccgaaaaacaaaacaactgaagggaatgtgtaatatctttggaagattgcatgtcacatcaatttaccccttgtgaatagaattaagataattaaaaaagagacttcaaggggcttctttaattgattctgcatccttaacttgaggcccaaatgttctatgactcctttttgttctgttgtgactgctattctctggttctacacaacacaatacatacatacatacatacatacatatatatccaaagtcttgttccccaaagcccaaattccaaccatttatgacccctttagttttctattttacattgtgtgagtataattgagacttccaaatgtacactcagtgtttgatactctttgaaataaccttcattttgaattgatcgtttttataacttattactcttttaaataataaaaagctaaacaacacatcaagtcttcttggattcttttgtgattatgttctgtgtcaaatatctaagttctagaaaacaatacttttactagtccctattttgatggctgaaatgggattagatgaaatgggagtagaatgttgatctcttattcccactacaaagagaatttcataattcccttctctacataattcactccactggactccactctgctatagaaagagtccactttgacagcaacaaagactggttttgatgatttaagaaagtaatacacatgagcaacagtctacactttcagaaatcatctaatacctatgatggcattcttgttggtgttattctaagttaaggcattgctttactactatgcacatacacaatcaagttcagaaacacggtagcattttgtcagtaggcattagtgctcacattcctgaggccaataggtttagaaacccacactcttggctatgttcttccacaggtggcttcagctggatgttggcttatccaggctggccttggctagggtgagtcacacacctgcagttcagctcacacactcatgggcattgatgtgctctgattctaactcattttcctcctaggaagtcaagctagttcaggttcacttttttatgataatgagagatggcaaacacaaataatgttccagctcacttcaaggatctccattcagaatggaggatatatcatgatggtctgggtgcatgggcacccaggagctgagaggtggagtgctccaaaattacaatggtataatcctggatacagaaagagagaggaattgtggccatgaatgtgttcagttttgacattcattgtatacaaggctgtcttagtcaggatttctattgctgtgaagagaccatgttcaatgcagctcatataaaggaaaacatttaattgatgctatctcacagtttcagaggtttagtccattatcttaatggtgataagtaggcaggcagataggatgctggagaatgagctgagagttctacatattgatctgcaggcagcaggaaaagaacacatttgagtttctgagacctcaaagcccaccccttcatgacacacttacttcaacgaggctacatctgctactgttaccactccctatagactaatagtaaaacacgtgagtctattatgggcatttctattcaaaccaccacagaggccaaaagcatttaaaaaagtatagattgaatgtctggtgagataagacaatttcagaaaacaatgttactgtgagtcttgtcccaaatatgaaatctgaactgctgtgaatggttggaatagaagcacatccaaagatagttactggtttagataattcattaaggactgaaatcacttgtgttttctcgttggttcttttttcaaaagagagggatgtgtcacctgccttctgtttaattgacaaagatggtcaaaagcatatgatagtaatagttgcagaactctttggtacgataaaaatttctggattggatatttttaatggtctagtttcaaagtaggtaaattgatcctaattaaggtgttattaaatattttaaacttaaagtacctctaatattattttaatatcattaactttattattattaggtttcaattaattattgattgttatttaatatattattacctgactaaatatctacttgtgttttcttttaaaattacagtcagcagatgaaaatactttagtagaattttgaaatgctttcttgaaaactgatcttgttagagctggagagttgactcagatatatagagctcttactgctcttccagaggatctgggttcagtttcaagcatctacctagctccaacatcagtgaatccaatgacttcccctagccctcaaaggggtacatacatatagtgaacagatatacatacagtcattcatacacataaaaataaatgtaattttaaaccttggatctgtggattgtagtatagttgtcctttattttgtggctaatatctagttatgaatgcatatttaccatatttatctttctgggtctgggttacctcattcaggacaattttttttctagttatattcatttgtcttcaaatttcctgatgttctttttcttaacagctgagtaatactccattgtgtaaatgtaccatattttctttatccattccttggttgagggacatctaggttgtttccaggttccggatattacaaataaagctgctataaaaataaaaaacaaaaatgaatgctcttatacttcatcaaaagaaaagtaaattaatagcataaatcactgtcctagtaacccacattggagaaaaatggctgtcattattgttctttaagtgtatatttataattttgaatcaatatttcagagtcttaaagtatgtatgtcttagggtcctccttgtttcctcacttctctggaagtgtggattgtaggctggtaatcctttgctctatgtctaatatccatatatgagtgagtacataccatgtttgcctttctgtgactggttttcctaactcaggatggtgtcttctagttccactcatttgcctgtgaatttcaagatcccaatgttgccccccccagtaaatgtaccacattttctttatccattcttcagttgggtggcatctaggttgcttccaggttctggctattacaaataatactgctatgaacatggctgaacatatgtccttgttgtatgaatgtacattctttgggtatatgcctatgtgtggaattgttggatcttgagataaactgattcccattttactgagaaactgccatcctgatttccaaagtggctgaacaagtttgaactgccaccagcagtggaggagtgttccctttctccacatcctctccagcataaactgtcattggtgtttttaagccatttttacaggagtaatgtggtatctaagagttgttttcatttgcatttccctgatggataaggatgttcaacaacttcttaagtgtctttcagccattttagattcctctattgagaattctctgtttagttatgtagtccactttttaattggattattgggtgtttagatgactagtttcttgagttctttgtatattttggaaatcagccctctgtcagatgtgggtttgctgaagatctgttcccattctgtgggctgcagttttgtcttattcactgtgtcctttgccttatagaagcttctcagtttcaggaggtccaatttattaattgtccatgtcagtgtctgttctactggttttatgttcaggaagtggtgtcctgtacaaattcatccaagggtaactcccactttcttttcaaagaggttcagtgtgcctggatttattttgaggtctttgatccatttgtactcaaattttatgcatggcaatagatacacatctatctgcaatcttctgcatgtcatcatccagttatgccagcatcatttgttgagaatcctgtcttttttccattgtataattttagcttctttgccaaaaatcatgtgttcttagctgtgtggattaatatcagcatcttcaattatattccattggtctacctgtctgtttttctgccaatatcaagctgttttcattactatagctctatagtaaatctttttttccagctttttttaatcagggttgagatgcctcttgaagttcctttattgtaccctgttgttttgactatcttgggtttttgtttttccacataaagttgagtattcctctttcaatgtctgtgaagaattgtgctgggattttgatgtcaattgcactgaatatttaaattactcctgctaagattgctatttttactatgttgatctttcctatccaagagcatcagacatctttccattttctggtgtcttcttctttattatttatttatttttattggtttttcgagatagggtttttgtgtagctttggagagtatcctgttgctcgttctgtagacctggcttgccttgaactcacagagatccacctgcctctatcttccgagtgctgggattaaagacatgtaccaccaatgcccggcactggtggtatcttctttaatttctttctttaaagactcaaagttcttgctatataggtctttcatttgtttggttagtgttgccccaaagtatgttatgttgtttgtggctattgtaaagggtgatgcttctgtgatttctttcttagcccatttatcatctgtatataataggactactgattttttgttgttgttgtttagttaatcttgtatcctgccactttgctgaaggtgtttataagctgtaggagttccctggtagaatttttcaggtctcttatataaactaactgtaagtttgacttcttcctttccaatttgtatccccttgatttccttttgttgtcttattgctctagctagaacttcaagtaccatattgaagagatatggagatatggagtggataatcttgtcttactattttatctattattcaaatattttcaccatgagatacttaataaaataaaatattttgaaaatagagttgtttttgttacacagtaataactgttcctacatgcctagtattggctcacactccccttcacatctgtatggtccccatttctctgcttctcaccctcacttaagctcttcagtcccagcatcctcctttcactttcaaacttcatatgttctattactttccacacctctctcccacaaagccttttttattctcctcttaccatccctttcttgttcctgtttctaacattcccacataaactttgaaaaatatattattttactgaaactcaactgctgcatttgacatcaggtagtgttagattaaggggaaagttctatttaataaatatgtgatataaagaaagcacttgaaggtgaaatatgtgtcctgtcttaatgtgaggggtgtgtctgcagggaaaccaacccttcccagataaagagaattccagtaataaataccttgagtgcagtgtagtagagagcagttctgttctcacacacatgcagagccatgactctgctgtatgttttctcatatgctggatagtggctcctctgtcaagctatgcagggagagaaaaatgattagtctatatgtccaattgattttgcctttcttgtggagtgtgtcaaataaattgcatttttcctgagcccatttagatggagtattatcctgctgtgttcctttggatcctgtacagatttgtgattgctgaattgtaacactaatcataataattatctatgtaataagttcacaatatgaattgctacagatggtcacattttctatcacagagcaatcaagcctatttgtacaatctacttgcttctgtataaaacaaagagcaacatgcaagtttctgtatgttcatcacacattgtaagtggcaatttaggtctagtgcatcagagaaaatgagagatgataaggcagagtgctaaagaactttcaaagagagtatatttggattttactattagtttttcagatattatctttctatgtccgattaaatactaaagagttgttttcacacagtgggcaattccgtttctctaaaatctgaaattcattttgacagtggagaagaggtaaatgaattataattcattataatagcattgtaaatacaaggtgctgaaatagaatgtgggcatatttgtgacctgaacaacgatggacctcaggcactgtctgcaactggaagcagtttgccttctctgtgtctttatcacgtactatgtgactttggtcaaggagctgaatctagttgcctgtacagtgtagtaaatactatgacattgcatattttttacctttacttcctcattgctgacttttaaacttgactcaatgtttcttaccaacattttccctggcagtgccaaaatttctttgcagcagtgggaatattacttctcctccacctttcatttaatatttcatctaaatcaaagtagacttttgctttttgatggtaaatactgcagaatgcacaaaagtaggctagcaaacttagctgactgttctatgctttgtatctggtatatacgtgtaaacaaatgcaaatattgatgttcatctattacctatgcatatttatatctgtatttgtgtgtagtacatagacatttatacatatctacatctgtacacatttacatacttctgttaatctttttatttatccatgtctctgcatttttacatacctctatttagcaaaaagtatgattgtgttttgtttgtctgcttttatttttccagtgctaaggggataaacaagtatgttaggaatgttctctattattgacatatgtcccaagctcatatttgcttcatgagagtttttttattctatttgtcattagattttagatactgagaatttctgctgatacatgctcttatacattgtaccatctgcattgcatattgagtagtatttattagaagtcccagtagtataattgtttcttatattattacaatacataaatgatttaagaaattataacttgaatatcaaaaacataattgtgttgacagccaaaaattttgtgtcctggaatctgaggaaactagatgtttttcataaagtaacaatatgaacttcctgttatatcttaactgaccattcttttgcttctcctttctattcttttatagtttcctaaagcaaatgcagttgttagcctctttatctctaattttgatttgcttctttttgtcatagtcttaatttcttcctgtttattttaaacaataaatccttaaacattctcagctttctctttggagagataccttgctcagcctaggtatatgagggatgactttagtcctgcttcaaggtaaagtgttagactttactgactccccatgggaagacttaccctctggggagtggatagggtgtgggatggtggtagggaggtggagagagcatgagggcacaagggagtgtgaattgggattggtatgtaaactgagaaaagattgttttaaaatagaaaaatgattaaaaaattctcagcttgagttcaatcccttgaaaccatttgaaagagcccaacatggtagtgcatgcctgtaatcccagatctaggtagttacaaaagaatttccagtgcttgttggccatgcagtccagcaataataataataataataataataataataataataataagtgaataccatttccagggaaagaccctatttgtaaaataaggtggagaagtatagaaggagagttctgatattgaccttgcatttccatatgcacttgtacacatgttgcatgcttgcatgacaacacaatactaaaaaaaaaatggcttagggcataactggcggaatagaaactatatcctggggatgatatggtctaatgtgtatctctcacttctttaccagatgacaataagtagatatgtagtttctgatgtctaagactttaattaatactaaaatgcaaataaaatgctttcttccacgatgaaataatccttgcctgaggttcacagacagtgtcctgtgcttgcttcatctatttgcccgccttagtcactttcctttatacaattactaaccccaattcctgacatctttcttgtggctctgatgtaattcaaaccctgatgtttcattatttttcattatttccacataagccctactcttagtagcagctggggtgaggaacagaagcacagctttctggtgctgtctgcagcagtctgagaaattgtgtttgagacctctattcaggccaagccagggttcttgactccattgtagaaaagaatttcaagaaaaaacagtacaaaacagacttggtgtttaccttgagcttttaaaacaggttgaagcatgagggttaatagaaagagaggcatacaggggaataaacacaggtaagcatggatgtatgcagacagagtaatgtacttctcagcagaagcccatgtacacttctggtgactcacatgctacattgtttaaaggatcctttcagtaacactccctcccctttctggctttttgataaatgagatcctagagtggaggtgactgggtaggattgcatctgacataataaaatgagggtaacaagacctgaacacagggattaagacataattttagtttgtgggttcctgaaaattagagtatacagaggtgggaaagaagaaagtccttacttgatcacatgtttatggcttaaacatgtttcttggctactttaccattgttacctgaaaactatatacagaggcaatcctgtccttctgtgggcaagtttgttaattgtactagaattttattttttattctattttatttgtttttttgagacagggtttctctatgtagctttggaaactattctggcactctctctggagaccaggctggcctcgaactcacagagatccacctgcctctgcctcacaagtgttgagattaaaggtgtgtgccactaacacccggcttagaattttgactcacatcctgaaaaagacttcagctggatttcaaagtgagttctcccttccctccccattacccttagcttttgttttctatcctgtcttgttttacctgttaacacacctcacaccaatcagtattagcttattatacattagcttttttttattatttctccttagcatgttttgaaccctttcaaattcaacttttgtttttaaaaatgaaaaatttatgttcattgctacactgaatgtttattattcttgttttctatcttacacttttgcaataaacaacaatctttaatagtgttttggatctagctgaaatgtaccaaaatcttgacattccatctactcttatgtgattccttttgcatagtcattggcattctgaggacagagtgaccttcctcctctgatgtccatcttaggaaccttttcattcactgtgattcacctagatacaagggatgggctgaggtcctatctcaaaggatatgacagattcaaagagcccctattgaaggcctcaccctccctggggcgcaaaaaggctattggataggtaggatgttagttgtggggccaggagagaagggaagggaaggaggggaggaagagggaactggaattttcttgtaaaacaatcttgtttttattcaaattaaaaaattaaaaaaaattaatctggacagagtttggacacggttttctagagaactggcataagtactcattggcattctattctggaaagactgaacacataaagctaagtattaactggaggagaaactcctcttagaacagggaagaaatatcaaggttgttctgtgtcagttagctgcaatcaggatggtactgaatgcacgaactgatgaccactgtccctgttattggcagtgctgatttaaattcttgatccatttaaacaagtgctagattttttcattatattttcccaggaagacaaaagaaaaatgttccagagaaaaagatgagagtgaaaatatttcacacacaggtgcttcagttacaattgtacctttgtcttggggggtataatgcatacccttaacacaaatcccatttttcatataatgtaataacaactgccgtgatatagtgattgatattataaaaagtgctgtgagagaaatgctgttattatgaaaatcctattagcaagtctcagtgtgctatacatgcagggcagatttattaacataccctctgcagtcactttgctgaaaacagttttaccagctatgaaatactatataataatgtcattaatagatgtgtctaattgcagtatataaaagtgaaacactgaatagcttgaaatggctctatgagtgctgagattatttgagtagatgtgatgaagaagagacaagccatgcgccccatttctatgctgtcctgtgtcaagtgatagagccttaagtgcatactgggttagactaatgagaaaatgttgggtcttttataaaaatctgtcagtagatggcaatgtgactgttttatactgcatttttataccatatggattgaaaattttgagatcattcgtgtttgctgtctaagttactgtaattcccccctcaagaattccaagatcccttttagactattctttgaataattgatagttacaaatgaaaagccatgcctagaatttcctaagtgatcaaagttgttttaattttccagtggtcagggttgaataaaaataatgttacaaactataccatcaataaccagggaacacagagtttctcaagttacagccctttgaacaaattcctgctatcaccacacttaaggcagcaatggcccctggcacctgatatagtatggggctcagaggaatgagcatgcactaagattatcttgatatgttttcttttcttccttatttccacatttccccgtcagatgaatcacctttgctattatttgtgatgtttatataaacatacaacctttatgttgcatgtaatgtgtgtactgtaatatcaaataagcctaaatctcaaaagcatgttatgcagtttgcatatgctgtaagtggcaacggcttctggattcattaagggttacaaaacccaagaaggggaagtgcctggtcttattgaaaattgatatgccatgattggttgttatccctgggagatctgcccttttatgaagggaaacaggagaagtagataggaaggggagaggtgtagagggacttggacttggacaagaggagggaggagaaactgtggttaggatgtaatacatgagagacaaaaagtcccatcccaaactaaggagctactgtaactaattcgtgttgggaaaggggaaatcagttttatccaattgagtgtctctgggtatatccaccacactccagggcaagacccatgcccaggaatagttatacagtacaaacagactccatttgtgtgtgtgtnnnnnnnnnnnnnnnnnnnnnnnnnnnnnnntgtgtgtgtgtgtgtgtgtgtgtgtgtgtgttgtttgtttgattttgttatttattttatttttttcttgttgttttgtttgtttttgagagggaaggccaagatgaagttaggtggggaggtaggtttgaaggatctgggaggtggacagaatatggtcaaaatatagagtttttgcatatatttttttctaaataaaatacttttactcaagaccatgctggggaaacacacagaaacagctgacctgaggaagtgtgagctcactgaccccagtatgacagctgaggaaccagcatgaaaccaaaccaggcctcctgaacatgggtgtcagtatgaagcctgggcggtctatgggcctttggcagtggactttggggggcccattcccaatggagggatactctgttagtctagatgcagaagggagggcctgggccctgcctcaaattacagggcagacattaatgatcccccattgaaggcctcatcctccagggtagtggaaaggggtgggatggagggtcgacagggggcttatgaggatgggaaagagcgggaaactgggattgacatgtaaaataaaattgtttctaatttaaatgaaaatttatatttataaaaagaacttggaagcagtttgaaacatcaacaccaaaggagacagtacacctatgaacataatttccccaaaagtcaccacattcctacccatgaaactttctattatccagagatattaaatttgcttttgctcttgtttgtgacaggaggattcagctaactcaagtggtcattctaatagctaataatgataggaaggtgcatgttccaaatagtttcaagtttcctttttaaggactaactcttaatcattgcaacatggaagtctctgttatggttttgggttaaacggtggatttctttaggtgttttcagtgtctgatgaagtaccttgtgatgctcatcctgttgtaatatattttccattataagtgttctctctggctcaaggagtattcctctatgtggaatgggttcccaaagtccacaactatgctagggataagtactgaactacaggaggtcctgtagatttccaaagtttcctcactgaaacccatgttcctggggtctggatcagtcccgtgctggtatcccagctatcagttgggggacaaagagctccctgatgttcaggtcagctgtttctgtgggtttcaccagcctggtctggacccctttgcttttcacttgtccttctctgcaactggattccagttcagttcagtgattagttgtgggtatctgcttctgcttccaccagctgttggatgagagctattgggtgacatataagacatataagtcatcaatctcattatcaggggaggtcatttattccaaagactatagattctgatgacacattaaggaaggcctcacaatccagggagagcagaaagtatatgtgataggtagggttttagttcgggccggagggggtagtaggggaggaggagagggagagggaactgggattgtcatataaaacaatcttgtttctaattcaaataaaaaaatctgaaaaaataagagttctctctgttgtgttctgtgttgaggctatgagtaaggggtaagatttcattttaattttatttccccaacagggtttggatctgactttcttggcttggatttttttttttctatgaactgaattaaagttgagccattgccccaagcaagaaaaatcagactcaatgataccaattatttgcaggatagttgcaatttatcttcatgctctttcattgttcattaaaagtaattacccttatttttatcatgtcacttgtttgcaaatagaggaaggaagtgagtttggaggatctaaggtatcaggtaaatgtattaattttacttaattttttttttggaattccatgcttctttatgcccaagctctcccacatctctctacattaaaaatagaccctttcaaccctttgcaaaattgtctgaaattttaaatgaaactatcttttcaattataacaatagaattagtgctggagagatggctcagtggttaaagcatttgctgcttttgcaaatggcccaccctgttcattttttatcatttgtgtggtaactcacaaccatctaactccagttctgggaggtccaacaatttttctcgtctctggggacacgaggcatgcacatagtgaaatacatacaatcatgaaactacttattcagtattacaaaaataaatgaatctttgatcaataaatattgttgtctacatatttctaaaatgaagccaaaaagaaatacaaaattaagaactgtaatactagtaaaagactagaattccagctttccctttgtaaagagaatttttatcgttaaaaatcatgcatatttcttaataaaacaggcatttctctgcaagaaaacacataagatacacttttggatttcctttgggtgtgcacattagagtaactgagctctatttatctaaaagtatcctttttttccaaatatccttgaagttgttctttaatcaatcattctattagacatttctctatctgcatcacatgcataagtatgtaagaaatcttgttctgtgaaatgaaatttaagaaattatttttaaatcaagtatctggataaaaagttatgaatcttcaaattttcagaattatctcacagacctgctaaaatacaaaaatatatgtttcctttgtctatgggaatatttatacattttaaaaacagagattttttattaattatttatatctataagaatcataaaacattcatagtagtatcttacattttatcatttttgctatgctcttgttataacacactatatggagacataaaacaaagtccactaagcttttaaaaagaatttgacagtcatttgtaaagcatggactttgcttttcaagacaagagttgaaggagtagcatttataatttagttgctcttactatctgaactttacattctcaaggtctcctaagggcttatatattaagggttagattgagcaatgctcaacaacaattttctttgaactatcaataatatggcagaatggcctaagacttcaaaatcatatagtaatcaatctattttcaagaaatgtcttcaaaaatatgaaattaaaagaagggaccatttgcattaaatatcttttacattcattatttcaagaacagtatgcagggcagttttttttttgtgtgtgtgtgtgtgtgtacgagtttgttttttttaatttaaattagaaacaagcctgcttcacatgtcaatcccagcttcctctccctcctctcctcccctgccttcaccatctccccaaactcccaggtgaggtcatctctgatggatattcaaagtctgtcctatcatctggagcagggtctaggccctcaaccatgtgtccaggctgagagagcctgcaatgggttcctaaagtccatttctacaccagggataaattctgatctactacccaaggccccatagattgcagagaccttctcacagacacccacattcagggggtctggttcagtcccatgctggcctctcagacagtagtctggggttcatgagctcccccttgttcaggtcaggtgttctgtgggtttaaccagccttgtgatgaaacctttgctcatcatttctccctctctgcaactgggttccaggagttcagttcaatgtttagctgtgggtgtctgcccctgcttccatcagctcctggatgaaggctctaggatggcatatcaggtagttatcaatctcattatcagggaaggacatttaagtttgcctctccattattgtttagattgacagttggtgtcatccttgtagatctctggaaatctcactagtgccagatctctcctcaaacctataatggctccctctattatggtatctttcatctattcttccccctcagccatcctgctcccccatgtcctccttggtgtcagtgagcaggaggaccccatgccccaaggttcccagagaaagagggaaacctgcagctacagcctgccctgttggaccactgagaggcattggagcagcttccatatgctcaagccctcctggcactcttgggcattggactcagcacttctaagatgataaagacagatccagataaagacaaacctctaagggtttataactcgggcaggaggctgttgtaaagctcacacatggcagtggggctcaggcggcttttggcagaaagatttatagtataagaatggtgtcagtgagtgggatgacccccatgccccaatgttcccagagaaagaggtaaacctgccaccacagcctgccctgtctggccactgagaggcattggagcagcttccatatgctctcgccgtcccggtgtttctggagtttagactcggcacttctgagatgataaagacagatccagataaagaaaaacttctaaaggtttacactatatttaaaaatatatgtgggcttgtgagagaaaaagtaacaggaggaaatagagtagccggttatggtggccaatgccagtaggatttactgaaggaagcaaaggcaagcggatttccacagagaaaccctgtctcagaaaaaaagaaacaaaagaaagtaaaaataaagtaataaaaaaaacacataaagatggaaaatacacagagaatctggataatatatgccatattgttgtctttaaattgtttgattgccgaggaaagacttactgctgctaaaatacatttgattataaatgctactaaattaatccaacctatacattttaaaaatactttgacttcaaaatttaagtctaaggacaggctacttggaaaaagaatttctgtttgtgtttccacagaaaataaaaagctatggattccttccagactaatatggtttggtctagtaagaccccctgaagctgagatgatacaaccttacagactacaaaaacaaggacttggtcaagtttctatgttttatcatgatcctaatggtatacatcgtccccagtcatcaggaagcagtttagaaagaacgacgcccatattcccaaatattgtttataaatgtttgttttcatttaaatgaggttagttataaatgataatgaacaaagtcaatctacttttaaagaaagaaaaggggaataggatatgggaatgaatactttgcattggtatggattttcatttattggtgcaactttaaggtcaattttgtgatatgtatatgtctcctcttgtttgggtattgtgtttatgcagatcttttacctataatagtcagaacttataattaggttagttaggttttctagatatacagagatgtatttgagatggttaggtattcttcgggccttttggggacctacagaaatatggcatttaaatggtttagggtttttcttggctgtaggacacaactgctcctggcacaccaattacctcggggggggggagaggatgggcatcgaaggggctcattgtggggtttgctttcaatgtggcaagattggctgtttgtttaagtattgtgtttatacagatcttttaaaatgatatgcataattaaataaggttatattatcacctatgatagtcagaacttataattaggttagttaggttttccagatatacagagatgtatttgagatgattaggtattcttcaaaactttcaaagacctacagaaatatggcatttaaatggtttaacgtttttcttggcagtgagacacaactgctcctggcacaccatttacgtcagaaaggaagatgggtatcgaagaaactcgttatggagtttgctttccacatagcaagattagccatttgggcgagaaactgctcttgcctggactgtttgttgctgtataaactggacatgcaggacccacaagaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagatggatgccccaacgttacagaggaactttggatgactgtccaggtagtgagatgtcctgtcaattctagagtttatatattttccttctgcggtctttgatagagttgaagacatagttatggctatagttttcttcagttattataaaagataagttacccttctttttatttacacagaaaaggggagatgatggggaaagtacttctgtgtatgtttatcttattgattgttgaataaaatactgtttggccaatgaaacagcaagttagaggataggagtcaaagaagattctgggaaatgtagtagagaagtggtgttacaggaaggaagtgacatagcaaggagactcataagcaaggaaaaagaggaaatgtcccctttccccttcgcctcctccagcggcaggatgtgagccaccagaatgagagggcgccagaaaaaagcatcctctataaagataagtcttataacatatatagattcatgataattgataacttagctaatagatgagaaatcctagtcattggccaagcagctttgaacctaaaacaagtctctctgtgtattaatttgggccgtaacttgggcgggtggctggcgtaaagtgcacacgtagtgctgggtctcggaggctttggcggaaagatttatcataacacctccttgcccttcctcttctcctcctctcttttacccagctccctctaccctcccccaagctcccaaacagctcagaagatcctttcccattccccttctcctgggtaccatgcatatctctcttagggtcctccctgtttcctccctgatgggattgtaggccagcaatcccctgctccatgcctaaaattgcaggaaactttttatcaagtatattttttctagaaagttctctaaagtatcaactatgaaattcacttgtttttggaaatagagatttttaactctgatatagaccaagtatgttttcttcatgtcctcaaatttcatggattcccagagttctgagtattattgtaggcaatgtttagaggcaaatcaaagtacaggtttcacaatgtaaagtaaaagaatcttgaatctccacatgcttcttttcatgttgttactcagacttttagaaatagctttcatatcatgctgaggaattaatatctaaaggttaagttgaatcaatgtcatgcagagtcagaccatcctaaaaatcattaagttagtttcttccttcagtcatagctacattccttcagatatgcaaaaaaaatcacaagagaatttggaggataactatctattttattattaggtagcttcaaatctaaaagaaactggtcacacaatcaaatttgtaacttaaaatatttttacatggtgatgcattctttcaacccagaaccaatgggcataaaatggaggaaatgactctcacttccccaactttcccaatggcacatacttcagcactgaagggtggggcatccatatcccatcatcaactggtaagactgacccagtcttatacagattcagagcaggcatgtacatctcctgtgaattcatgattacaatggaaatgttctgcccagaaaagatctcacatccctttttcctatcttgtagctcttaccttctttctgtccatttcacagtgaggctgtttgtttgaaggcaaatggtcctcagaggctcatatttctttgagtccttgattcccagttggtagaattgtttgtcatgcattaggaagtgtggacttgttcaagaaggtatgccactggggatgggctttgaggtttttgaaggccttgctgtcttccaagtctctcactcgttctgccttgtggttgtggaataagatgtgagctctcagctgttcttttgctctgccatcatagactctaattttctgacactgtaagacaaatcaaaaactttacttggaagttacctttgccatggtgttttatcacaacaatggaaaagtaaatgagtcaaaagtaatgatacatctctaaggagtggatgagggtgggatgaggggatggtgcagggaatatgaggaagggagggagagagacttgggattaatatgtaaaacaagatatttttaatttaaataaaaataatacaaaagtaatgatataaatgtcttgtttgcaaattatcatttcacattattttcagaacttcatacagtaacgagtctctgtattcactactgttcacaaaaaagaaaggagctaccaattcaggctgagaatggaagttgtccatggctataaacataagtaattagaaggcagattgatgctgtgtcaacttaaatagaccaaagtcctcagttccattccaggtcctatggattttctaccatgatttttcctttgtctgttttttttccatacatggaagttggcctcaaatttaagcataatatggttagtcatctctgtaacagcagttctactattgcacagtgggcacatcttgcctggtagggtggtcttataaatcacaggcatcataaacagatcatatattgctaatttttcattctgaaattttatttgttcttttctaaaatgaaactttaaaacctggctttttaatttttgagattatgatatgattaaaacatttctctcccccccacattcttctgtataaacccccatgttcttcaaattcatggcttctactttctttaattgttattgtttgcaatcctaatttttcttccctggttgtccacatacaactttctgggtctatgaatattagctggcatgatagaaacttccagttcaattccaacgtgatttctgtgtatcttacaaccaagccatttgttgtctttagtaatagaatctggttgtagtgggcaatcaaaaggaatgaaagaaatccacattattttgagggtttatgagacttctaagaagatactccatctctgctactgagatttttttcaatacctctgtcttctagggaacagattttctcctgggtatttcctacacacacacacacacacacacacacactacaattaatttttttacaatatggtagatttttaagaatactttctcttaccccctccattttgattaatcctatttctccccatctcccttattctccacatctcacacctacttaacattttccactcctagcattccttggctcttctttcatgtttaatactcctttcctttaagtttcctggctgctataggaacactataggaacagaaatttaaaactagggccttcaagaagagatttttaaatatgtttgttacaaagtggcattctcaaagattatttgtggtgatcaatatggtatggaggtcatctagataaacaaaactttagtattatagagtgcattagtcatctcatttaataccctcatttgtgacattaaaaacttgatatataatgaattgaaatatatttaatgaaatcacatagctaaaaatgactaactgaaggaatgaaacaagcccatactacgtttaataacatcaccttctacagtaaaataaaaatgagcatctaggtgttgccaaaggagtgttagatgacacatgccaagctcaacaacccaaagcacaatgtactttatgctgtccaattcccaggatgttttccttgtgtaccaccttggttggaagcactatcacagatcaggtactcactttaaatctttaatattgtttgcaatcacttttctgtatttacgtccatatccatttaattgacaaccatattctgtttttttctagtttctttaatcctttactaatggatattcatttcatcataactaagtttattatctagattactggcttagtgtaaaagctgactgtaaagatttctatttatattctcttctatagcctcataatcttccaaccctccaaaagcaatattctggcaatggatgcttctgtatgaagtaaatagccattgaaaccctactaatatgatgccagtatcattagatattagaagggcataatttctcttcatgtgaggaatacatttttatcctgccactagctagaccatctaccttatccagcatccataaacagatcttcaggacaaattccttgaatatttgtaatagacagaaaattctacatttatatccatggattgtttaaacaaaaaagtgtagctgttcacactgtctcattctcacaaccctgattgaccataggaaatactgtcaataaattgagatgaccaaagtaattggagggaggttaaatatctgtattactaagtgattgctgaatgaaaatggtttgtgtactacttgtatgtgcgtgaactatgttttaagcaaaaaactttgaagcagaaagtaaagcattggttgttgtaaagtagtacaagaggaaatggtaatatcttgaagaccaaaaggtgaaactttgcagttatgagaatgaaaaaatctggaacttagcatactttattctgtttgtatacattaacaagtaaaacaatatcacaatattcatagtatataaattatatatacatagtaaaaagaaaaaaaatatattttctttcttatgaagcatcatagtcctacccttgagaattttgtttgtcctttgttaatgtgtgtgtacattcgtatttgtgtaattgttctgtgttacatcctaagaggaataatgaatctgtatgtctactgcttctgtaagcagaaaaaattcaaagaggtttggacttgaggaaatcaatttggataactgagaatacacgcattcttgtttgggaatgagcatagattataccaattcaaaaatatatataaagaaatgtgaaaagtggacatgggtgaatgttgaaagtggatgcttttccatatattcacatttatatataatggaactaaaatcaaatgtatccaaagacagatctgctataaagattttttttttactgtttagttatcccatgtagacattagctgtccacatgttaagttactgaacttcaaccattaaagaagtaattctgaagatgaatagttcatgggattttacactttggggtattaagtcatctagtggttaatgtcaattgtcagcttaacagaagttaatatgtccatgactgctcatattgtcttgattacaatgattgtagtaggatgatctactcactgagagaggcacaaaaccatttgccaggaacacctgggccatataaaatggaagagcaggcacagtactagaatacatgtaatgcattgactattttctgattgtgaatgcaatgcaagcagctgcttcaaactgctgcttgtcttgattgctccattaagagggactgtacatggagctgtacacttagttgaagctctttttgtctctgcagtttctgttagaatattttaccacatcaacaggaagataaagtaagagaataggcaaagaccaagctgagacaatgagaacaatgcagcgaagcttgctttcctcttgtgctatgtaagagaaaattggtatttgacttatgggaattaagttctcatatacccatgtcatcatttcatctgtgattttgcatttagactgtgattgggagtactaatttaataacaattctgagaatgtaaatgtttataatgtgatattattttattaggaaaactttcataactatacagatggtgttctcaaaaggtgaaaataaaaacgaacctagataaatcccacaaatgttaattatagtgtttccatatttcaccttatctgaaaaataggtttaaaaatcatgtctagaattatatgaaatagagaatataaatttggtctatttaggaatatgaggagatttaatgttcacctgtagatataggcttttccatcaagcactgtgactttctcctgtccttgactcctatagctatagcaaaaggctttattcaccaccaagattttgaagtctcccagcatataggaggcagagaaattattaaattattttctatgctcaagtcactgtggaagaacgttttacgccatgatcaaatctggttattctatctgtgtgcttccccttacttaggattccaggaagcaagttaaatcaaagaagcaatttagtttgtatgaattcactctatatacagtcattaccttgtaaattccaacaattccactaaacattatggaccttgttaaagtttaaagaattcttatgtctgaatagactcaattaattacttttcaaaagaggagactctgatagtgacaaatgaagtaaaaatgaggtagcagagtacatcagaagcattgaatgggaaaaatgccattgttgtacatctttagtagtgttggtttcacagcctacacccactattaatatgggttccaaaatggaagagatagcatggaacattcttaatgttttccacttccattcatctctatacaaatggtcatgatcagtttttctttaaaattattattacatttgtttattgtacatgagggtatggaagctgcaattactacagtggtcattggaggacagaaggcaactcatggtagtcagggtttttctttttttttttctttctaacatgtgagtcttacacactaagccatctctcaagctattgactaaaactcaaataacacataaaaccgcacacacttataatgggagatttcaacaccccactctcaccactggacagaaacatcagacagaaacttaacaaagaaacaaaagatctaacagacgttatggcacaattggacttaacagatctctatagaatattcctcccaaatacaaaacaatttaccttcttctcagcaccacattgaactttctctaaaatcgatcacatacttggcaaaaaagcaaacctcaacaggtacaaaaaacttgaaataaacacctgtgtcttatcagaccactatgctttaaaattagaattcaacaacaatacgaactacagaaaacctacaaatgcatggaaattaagtaacacccaattgcacaattcatgggtccaggaagaaataaaaaaagaaattaaagattttctagaattcaatgagaatgcagacacaacatatccaaacctatgggatactttgaaagcagtgctaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttcatgataaaggtcctggagaaatcagggataacaggaacatacttcaacataataaaagcaatatacagcaagccaacagccaacatcaaattaaatggagagaaactcagtccaattcctctaaaataggaacaaggcaagactgtccactctctccctacctcttcaatattgtccttgaagttctagctaaagcaataaaaaacaaaaggagattaagggaatacaaatcagaaaggaagaagtcaaactcttactatttgcagatgatatgatagtctacataactgacccaaaaaactcaaccagggaactcctacagctgataaacaccttcagcaaagcggcaggatacaagattaaatcaaaaaaatctatagctactatatacagatgacacattagtagagaaagaaattagagaagcatcaacctttacaattgccacaaacaacataaaataccttggagtaacactaaccaaaaaagtgaaagacttgtaccataagaattttgagtctctaaagaaagaaattaaataagatacccataaatatctcccatgctcttggataggcaggatcaacatagtaaaaatgccaatcttaccaaaagcaatctacaaattcaatgcaatccccatcaaaattgcaacacaattcttcactgtccttgaaaaaacaattctcaactttatatggagtaacaatagacccaggatagccaaaacaactctgtacaatagaggaccttctggaggcatcaccatccctaactttaagctctattacagagctaaagtcctgaaaacagcttggtattggcacaaaatagacaatggaatagaactgaaaaccctgatactaacccacacacctatgaacacctgctttttgacaaacaatccaaatatatatgatagaacaaagagtacatcttcaacaactggtgctggcataactggatgcaaacatgtagaagactgcagataaacccaggccttttgccctgcacaaaacttaagtcaaaatggatcaaagacctcaacattaatccagccacactgaacctactagaagaaaaagtgggaaatacccttgaattaatcggtacaggagactgcttcctgaacataacaccagtacagacactgagatcaacaattaataaatgtgacctccttaaactgagaagcttctgtaaggcaaaggacatagtcagcctgacaaaatgacagcccacagactgggaaaagatattcaccaaccccacatctgacagagggctgatctccaaaatatacaaagaactcatgaagctattctcaaaaacaccaaacaatccaattgaaagatggaatacagaactaaatagacaattctcaatagaggaatctaaaatggctgaaagacacataagaaagtgttcaacatccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgagtctaccacaagatccagcaattccactcctaggcatatacccaaaagaagcacattcatataacaaggacatatgctcagccatgttcatagcaacattatttgtaatatccagaaactggaagcagcctagatgcccctcaaccaaagaatggatagagaaattgtggtacatttacacaatgaagtactactcagcagaaaaaatatagaatcttgaaatttgcaggaaaatggatggaattcgaagaaaccattctgagggaggtaacccaatcacaaaaagacaaacatgatatgtactcactcatatgtggacctgctttatgatacatagtagtgaccatgctttatcagagctgtgtttaatgatgttgctcagaatggtttcctcccagatgatgattgagaagctaatttaaaaaaatggtgctaagtaacacaagagtaacaaaactgtgctcttttctgggattttttattttacttttttgttgattatttgtttgtttgtttttttttgtttttgtttttttgtttttttttttaaattgagtgtgctggatgtctctaaaattttgttcaaatgtctgcagaacctggaaaacctgttgctgctattgatgcataacatattgctatggaagctgctattactacattggtcattggaggacagaaggcactcatggtagtcagttttttttctttctaacatgtgagtgttacacactaagccatctctcaagctattgactgtatctttacagacaaataaaattccacatgtgcagtgttttcattgcctacttatctcttcatggatatccagacttattcttttttgctagttattttaaataaagcagcaatcaaaatgggtgtgaagctgtcatagtggtgtgcctgagtgtgtgtgtgtgtgtgtgtgtgtgtgtgtgtgtgtgtgaatacattgtgaaactagaaatggttatgaaaaagaagaaagagatcttaaggtaaagacaaagagaaagtaacatgaaagtagaaaaaaaagtagaaaaaagagactgtttgagaagaaaggatccaaataagattgggggagaggacatggagaagaactgtggagaaaaggaaacaaattaggcaaaacactataatgaaccatacttctttgtatgctaatgctatgaattaattcaaagaaaaagccacaagaaagacacaagaaaacatcaaatctgaaatgaaaagagggtaaaaaaagccctcccagaaggattactggcaattatctttgttggaagagtgtcattttcttcagtgttgtagctactgctaagttgcttttgctccagtacatgacctcatgcccacactcatgcaagaaattctagtcaaacacataaaaagaaggcattgaaataagaggtgactaagggatgaaagaggaatgaatctgaatgaaaactaaaatcattagttaagtatatggaactgttaaataaatgatttgaaatcattttaaaaacattgaggttttttaatctataaagttttttattcaaaagtttcagactctttcaaatttagaaacatttcaaatgccaaagaaaggaaacccatatttaacttgataattaaatctttatgaagtaaactcaagaaaaacattttcttaaccttcccaatcaatttacctaatacaatttataggtaattcaactaaccagcaagtagaatgacaaaaacaaacaaacaaaaacattactgtcttacttgtttgacttgtctttattttgtgagaactgaagaccccaaactaagctttatgcatctggacaagatatctatccttgatataaaagccttgtcaccttattttgttcttaaagacatgacatagctattttccttggtcttagattagctgggaaaacagatgtatataacaccagatctaacagtgttttaacttttattgaattcctcttacatttattgatttttgtcagtgttaacacagctaccaggtcaatccaataaaaactgaggcatttctttatctggttattatcaaggatatcttgcaaaatggctaccttgaaatatataatcaagttatttgacaaggaaacgaatgaatatggtatttaatagaaaagtaaattctgccagtaaaaaactaaaaatttaaaacacgtcctctaagactttagaaataaatagggctataagaaaataccttctccttcagttgagtacataaatcaggtaatagacataaaccagtgtacctgatgcctacattgtattctgggtcatctgtttatcttttccttgttttttaaaaaaatttattacattttatttattttattttaggatattatggaggtgccaatgtgtgtggaagtcagaatacaatgtatggtgtaggctctttccttcaaccaactgagtcctggggatggaattcaggttgtcaggtttgaggcagacacctttatctgttgttctatgtgtatgatcaatccttgatgctctaatgactcactcagcaaagcactgggggcatgttatggacttaacgatattttatggcaaattggcaataaagatacatcctctaatgaaaagtcgctatatagaaagggttaatagatgcacaggtctttttaataaatccaaacaaaaatagcatggagcagtaagaggaaaattattttctatttatttcttcctactttgtcttagaattatagttactaaattatgtctccagataactctttagaaatcagattcttaggtactttaaggaaactcattcaataacaatcgactcctggttttctgttgttgtttaattaaaaggtatttctgacacctctaatccaaagctctcattaaaatcagcagtgaaagcttcagtgtcaatcaagtagagactacatggctatggcaaatattaaaagcaccatttcttgccaagaaattcagataaagtgagtcaatttagacttacagaaacaaataaatgcctgatactaaatacttttcctggggagttgatttttattcacctaggtagagaaaacaatggggatccaaagaaatacttctgtcctgatccagcttgatgtacctgtgagtttacattctttggatggagactggtggctcaaaaggtaggtacataatggaaaggccagatatatggtgatgactgatgagaagttatttcactggagtcttctagacaactgccagtagttccttagacatctcctctcagccaaaatttcttaccactttacaggtttgtgagtcatttaggttttggggacctctgggtcttgcatgattcttgtgagttctgagcacctaaggaacttcttagcacccccccccagaagggaaaatttccattcagggaaatagctatgcatcacatttaaaaaatgaaaaaaaaacaactaatgtattcttgttaaaaaaatagtgacctcttttacataaaagctaaaagattataagctatcttttctttaccatgttaatgcataggtattgttcatgcaaataaaataattattctttgtcatttaaaatgttgttaagttttagggcattttctttttgaggtgggtgtggtgatatatcgtttatgatttaatgaagcttgtctgagtatcagcatgcaaacatagctacactagttagccataaatgccagacattggtgacacacatctttaatcccaggactcaggagatagagggatctctgtgagtccaagaccacccagggctacaagagagtgattcagtctaaaagagtagcagagatcatacctttaatccaagcactagagaggtgtataaggaagaagccaagggatttatgtgagatttagtttccagtcacagtaaagacaggatctcaatttcagccttggtagaagtaagagctactggatggctcttacttctgccccaatatctgtctctgggcttctattattcataatacaattgggtatcaaatatttttcttaaattcactaatgagtgagagaaccaggagatatgttgcaattagttaaagtaatgtccaaaggccagacaaatatataaaccatgtagcaatgctgtaataaatttctctcctttcatcctccctccttcctcgttatgcctttcctttattttcccttcttcctttcatccttccctctttcatttttttcttgtatttctttcctttggcagtgcagtgattgggactagggcatgatgggaagcaagaactctaacattgagttacatccccaaagaggaaataagttttccttactgatacagaactgacctatttcacagtggggagagaaaagtcatcagaaatgtattaagtgtaatagatttgtttgtctgaaaataattacatgaattaatagacgtttttatccataggtcttcagaattgttaaacaactcaaagaaaagtctaagtccaataagagctggtaaataagagggaatacgaagttgttttgtaattcctagtagacttaaaaatcattcgtattcctagtcacggtggaaatgcaatttaaaatactttgaaatactacctgacccctaatgactatcatcaataaagctgagaaaaaattttgaagataagaaacccttattcattattgatggggatacaaattaatatagccattatagaaatcagtttggatatttctcaaaaagtagaaatagaaaaaccatatgacccagctatttcactcctgggcattaactcagataactacatttcttgccatagagataattgtgccactttttattcctgttgtactcactatagcatttgaacaaacccacttgtaaatcatagatgaatggataatgaaatttgttaaatataaaattagaatactgtcagctctaaggaaaatgaagccattttgaggaaaatgaagtaattaaaatgtataatagtaaatgacaccatacaatcccagaaattataagaaaaaatcagatgttctccctcatatgtagaatctagcatgtatgtaatcaaatgtaaatataatatgaagaaaggagaacaaagaaggctaaatgtaagaggatcaggaaggaccaaatgcaggtcatagacatgagttatgaaagagtatataaaacaaattacttatttatttccattctccgtagatttttttaagtgatgcatgcatacatgatgattgtgaaaatataaaatctgatgtaaagcctcagaatatctatcctgaatagctactagctatgttgaagttcaatgaattgaatactctttgggcttggtttacttctgtatgcgatttatttttaaattttaggtttttttccttttattaaaaatagattttttctctcctgagccccactcctccccaaggtccccatcactccaggatctctctgggcctgcagctgcaaagagcaaacctgcctatatacagtggacccacccagacaggaaggacctccatgagtctggaaatacctcactctttcttccccctccgtctccctgacctctcctgagccctactcctccccaaggtccccatcaccccaggatctctctgggcctgcagctgcacagagtgcagcccagatagggtcttgagtctggaaatacctcactctcccttccccctcatgcctttcaggattaatactgtagatacagatgttcagttagcctacgtgtttccctggacagagtgctgtttgctactttttaaacaatagagttgatttttaaaattagattcattcattttattttatacatgaatgtttgctgcttgcatgtatgtgcaccatgggcatgtttgtgcccacaaaggttagaagagtgtttcagatcaccttgaactagacttatggatggttgtgtatcaccaggtgagttttgaaaatcaaatccagaaaatcaaatctgcaagggcaacaaaatatctttttttttaagcgaactttttaaaatttaaatcagaaacaaacttgttccacatatcaatcacagctccccactcctctcctccccttccccctaacaagccctaatcccattccatcttgagcaacaaattttcttaaccactgagctgtttctccagctcatttgacagaggaatttcaggaagaaatgagttagttgtatgtagttcaacctattttgtttgtttgtttgtttttcacttttagagatggttctatgtagctaaggctaactaaatgcatggtcttcctacctaagggctggaattgctggaaggcactcccacaaccaacttctttcactttcaactgaagtcacttgctttgatgtttccccaaggcttatatgtcaactagccactgttcactctccatatccagcagattcaaaataaccttgtgttgtcttcttgaaaaactgttttctgaattctgtatctattcaaaatcccgagaagaatccaattgcatttatgaaagttcaacaggattcttccttcaaaaacaaaactaaaatccaaaaaactccatctcagaatccaaagcaccacttttatgaagagacaaaatcttggaaactttaacatgtcctttaatgtaagagaaaccaggatagtaacagttgccccagggactttagtacaagatggagaaatccatagacatattgtggcaaagttcacatcctcctggcctgttgaggacattttctttaactaaatgttttctataatatgacttgaatatatgtaatgaaacaggaaaacaaacaaaaacagaaacagaaacagaaacagacaaaaagctctggacacaagactcttaacattgaatatattttattgaacatctgctacaaaaacatagtataatgaaattgcttatatcaaacaaacatcattcctctatgtattcagttcatcagtttcgtttgtagcacagtaattatttaagtcattttcctttttcctatatatattgcaagaacctgaaagttttacttgtgcctgtttttaatatctgtcatataagtagtggttcagtcctctatttacattgaggatagtgagtccgtattaccttgttaaagtgctaattataaataactaactcacattattttgaaaacttcagaattcttaatacagttcattatgtttaaaagaagagagctagcctggttaccatgcctatgatcatggcattcatggactagagtcaggaagattacaaatatgagatcattttgtgctatagcaagtaattgattttcttcagtcttttggacttgtgaaataatcagacatagatttattgtttctcaaatttttttgcatcaaactccaaaaggataaccattgaaatttccttagaaaaagtgctaggggaatttttgcttcagtgttttgcttctgcttcagttcctgggacagagctcctgataacaccaagtgactctttcataatagtatttgactgtggctcctcacatgtggcttctaatacctgagtagtagaattgccttctgttttaaacaggggaaccttgattggctttaaaaggcacttgtgaccagaaagacaaaatcaagttacatgtgtgcaggggacaggagctgaaaatacagttaatcctaatcatgcctacctgaagaaggtgtcataaaattttctgtgtttgggattgagtgaggatgtattgagatagtgctccatattaagaccatggctgagactcatctagaatgtgtctactttcacttggcacattttctgcatcaattagatgcagaaatcttaattagaaatctttttaattatcacgtaaatgtaagtaatgtttttgagttatgtataatgttcaagaagatttcatgaactcaatagagtgggataatgggagcccagatcaagtgataaccttgaacttgttattagactctgtagaagagagaaattttatgttaccgagattgctgatacatcaaaatatcttcaggtagatgatatcagaactgaactgaattagagaattcccagcttgtatcttctaggtattacttagtgtatgggaaaactctttagatacctgttgtgagaaatgtgtagctatatgacagagtgggaaaaacaaaacaaaacaatagcaacaacaagaacaaaaataaggggccaccaagatgactcaatgattcagagcagttgctgctcttgtgatgaactgggttctgttcccactacccacatattgactcataacaatttgtaactataattctagaatgtaaaagatcatttaataatgtataaatgataacaaagagaaggaaattttttcacatataaaactctggtttacaaaagtagctttctataaactagatgacaaaaatttctaatctttctctagaatcatactgttttaaaatagaaaagctgatcaaagctactatttttgatgatgtagcttgatttagtctgaacactattgcttacaatccagtgagataacttagtgcgtcactagttttaagttattttaaacgtatattaaacataaaattgtcctctcttatgtttggcttgcaatgccaagaaaagtgcaattttgacaaattgagatcagggtcagactatgcttgcttttgtaagaaagaaatatgttagggaatttgggtaattataagctgtgagaaacatcaaacactgaactacggtttggagctatacagatcagtgccaagacctgtgtacaaaccacttcatagcatatatgatgtttttaggaatcttggcttattgaattctataaatgtgaaaatataactataatatttcaaaattcataagcagtttgtgtgctggcaaagtcactgttcaaaatggttaccgaataggattatctacttagtcaaacaagctaaaccacaaaaataagatcaagcctagttaaaaatatgagaaatgcatgtgacttttcttctcccaaaattccttgctcaatgaagaatcagtaattttagggtgctgtaataactttagaacatgattcttgtccatatttgatgttattgaaatctagaactccaatgtctatgttaatttttccactgtcctcatattggtttctggatgtctcacagaattcgcaccaaatactatgaaaaattggtgctggcagcttgtcaggaagcattatttgcagatttgttgaactgtaccattcaccttgtacttatttgcaagtcttagagattagatttgagatatattctggttatctctggactttaaagtatatacaaatatttttgctattgactgtataatacaggagggagagcaataggaccacactagatattgctagaggaaaataactcagatatcagatactataatctcagaactgttgtcacttgttaagttctgtattagtgagactccccaaaggaaggttgggaatttgacaaggacttattgaaagtgtttataaagctatagccaatattacccaaatcaaaagggattgtatatagtgtagccactgttatacttttcagtttgaaaatgtgatgaagttaaaaggcatctgaacaaaatacaagatattcattagagatacattactgggaggcaaaattcttttgagaaagaactagggtcttcagtaccatggtccctttcctctacaatctcctagagacaggcaggatagacgtggtaactacttagcagatctgagttggtgcttccattgagggcaggcaaggcttgtagagccagaggggatttaaaatgtggacatataactttaattggttaagagtgagtgatgtgtgggggtggagttaatgtatatttatgtgtggttgctcatgtaaagtcaaaggtcagtcttaggtgtcattcttttcattcctcaggatgacatctgccttatcttttgagtcagatgcacaggttctaggccatgttggttcccaagggctgtgcttactggggagcagaaagggaatgggacagcaggttggtggggggcaggggaggaggggagggagagggaactgggattgatatgtaaaacaagctcatttctaatttaaattaaaaaataatataaaaaagacattccatggtaaatataaatttatgcagtttctgtctataaattcagctctatagaaggtgctagaaggaaaacttcagcctgaagaggttaaccacacccaagaatacacaaggaacaaataatctcaaacaaacaaatcaaaagagaggcaaaacacacactacaacaaaataatgagaatcagcaagcactgttcattgattaactttcaccatcagtggtctcaatttcccaataacaagacacatgctaacagattagatatgaaaatcgtatccattcttctgcaacattcaggaaacacacatgtgcccagttggcagcataaacagttacagcatcatgcagggtgagaccaatttgtctctagtggttaacattataactggtagggtcggggttctcacaaacatctcaccagtcaaagctagatcaatccattctacgttctctactattctatctcccatgggaatatatcaggcttttccatttattttataagcaacataacttgaaaacgtagtcttaatagatgataacatttatcccttgttcatatgtccatctctattaacttcttagggtatcgggacagttattagaaatgaaggagctctaggtttctatgattctgcttcatttcatgttcttagactgttcccattaactctattttattttctctgcatttattttaggctcatgccacaagttttagtttcttcagggatatctttttcttttgtgcatcctccatttctggctttggaagaatttgttccttttcattgaggatcttctcaaagtggcagggggagcacatgtatgggttaatcttagatgctttgttcacctggatatgttcactgaccagaaaatctacatcaaaaaccttaagttgagcattactctgtatttttaagcacatgcagcaaaaattcagcactcttttttggccacttaccctgaggccagacccactgtttggcctgtgatcacctaccaactccaccattataccagagtggcacaaattgcttctttaaagtgatatctttcagatatttagtggcttttgggaaatgtatatccttgatggcctgggcagtttcatgagtgtttttaaagtaaacccaagatttgaacttctttatttgcatgattttttagagttttctgggtcaggataatagtgaactatctacacaggtcacctcaggctgcttataggaagaggaagtgcaagggctactgccccattgacttgataccatctatttaataatacttctcaacccaacacttgaggctaaaattaacaacagttacacaaacatgtaatattaaacttcatgacatactgtttctcatgacggctagcattatggctatcatggtgaaagtaaggagagcaggtagcacatataatcaggggtcatgcctagaattatgtagctaactatccacaggtctttgacaagtgagtcagggtttccagggtgttgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgtatatttatgtgtggttgctcatgtaaagtcaaaggtcagtcttaggtgtcattcttttcattcctcaggatgacatctgccttatcttttgagtcagatgcacaggttctaggccatgttggttcccaagggctgtgcttactggggagcagaaagggaatgggacagcaggttggtggggggcaggggaggaggggagggagagggaactgggattgatatgtaaaacaagctcatttctaatttaaattaaaaaataatataaaaaagacattccatggtaaatataaatttatgcagtttctgtctataaattcagctctatagaaggtgctagaaggaaaacttcagcctgaagaggttaaccacacccaagaatacacaaggaacaaataatctcaaacaaacaaatcaaaagagaggcaaaacacacactacaacaaaataatgagaatcagcaagcactgttcattgattaactttcaccatcagtggtctcaatttcccaataacaagacacatgctaacagattagatatgaaaatcgtatccattcttctgcaacattcaggaaacacacatgtgcccagttggcagcataaacagttacagcatcatgcagggtgagaccaatttgtctctagtggttaacattataactggtagggtcggggttctcacaaacatctcaccagtcaaagctagatcaatccattctacgttctctactattctatctcccatgggaatatatcaggcttttccatttattttataagcaacataacttgaaaacgtagtcttaatagatgataacatttatcccttgttcatatgtccatctctattaacttcttagggtatcgggacagttattagaaatgaaggagctctaggtttctatgattctgcttcatttcatgttcttagactgttcccattaactctattttattttctctgcatttattttaggctcatgccacaagttttagtttcttcagggatatctttttcttttgtgcatcctccatttctggctttggaagaatttgttccttttcattgaggatcttctcaaagtggcagggggagcacatgtatgggttaatcttagatgctttgttcacctggatatgttcactgaccagaaaatctacatcaaaaaccttaagttgagcattactctgtatttttaagcacatgcagcaaaaattcagcactcttttttggccacttaccctgaggccagacccactgtttggcctgtgatcacctaccaactccaccattataccagagtggcacaaattgcttctttaaagtgatatctttcagatatttagtggcttttgggaaatgtatatccttgatggcctgggcagtttcatgagtgtttttaaagtaaacccaagatttgaacttctttatttgcatgattttttagagttttctgggtcaggataatagtgaactatctacacaggtcacctcaggctgcttataggaagaggaagtgcaagggctactgccccattgacttgataccatctatttaataatacttctcaacccaacacttgaggctaaaattaacaacagttacacaaacatgtaatattaaacttcatgacatactgtttctcatgacggctagcattatggctatcatggtgaaagtaaggagagcaggtagcacatataatcaggggtcatgcctagaattatgtagctaactatccacaggtctttgacaagtgagtcagggtttccaggctgttgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtctatcaccatgcacaaaacttaagcccaaacggatcaaagacctcaacataaagccagaaagacagaacttattagaagagaaagtaggaaaattctcaggccttgctcaccaaagaagtcacatggctcctaccgaaaagtatttttactaattacacatctgttagagagctaatattaaaactatgtaaagaacttaaaaaaaatggacatcaagaaaacaaagaaccgaactaacaaacagggtacagatctaaacagagtattctcagtagaggcaacataatagctgacaagcacttaaaaaagcccagccttgatgcaaggggaggagctcgattctgcctcaatttaatgtgccatgctttgttcaagcctgtgggaggcctgtccctttatgaatggagatgaatgaggaatagatgaggagtaaggtaaatggaaagtagtgtggggggaggactgagtagggaggagggagggaaactgcagtcggtaaaatgaatgaaaaacttatttaaataaaacaagaatattttaaacagtaaaattcaaaaaagagaaatggtcaacatcgttagttatcagcaaaatgcaaatcaaatctactttgagattccatcttacaccaatcagaatcaccaaaataaatgaaacaaataacagcttatgtttgaggatgcaaaataaatggacttttcatccactgctggtggaagtgtaaacttgttcaaccactatgaaagtcagtgttgtgctttctcaagaaactgggaatagatttaccttaagatccaactatgcctgtcttggacacatgcaaagggctctacatcctattactgaagcacttgctcagccatattcattattgctttattcataatagccagaaactgaaaagagattagatatctgtcagtagataaatggataaagaaaatatgatacatttctacaattgaatattattgagctattaaaaaaatcttaaaatttcaaggtaaatggttggaactagaaaaagatcaatttgagtagaataactcagaccccccaatatggtatgtattcactcatatctgggcattagctgttaagccaatattaaccaagcaacaatctgtagaaccacaaatattagctatagagtaagagttgagtcaccctaggaaggggaaatacaatggatggttactgatagatgaggtggggctggaaaaagaggatcaaacagggaggaagagggaagagagcagtgaaaaagagaattcaagaaagtacagctaaaactaagggtcatttaagtggtcagtagaatcttcctaaatatatacttatatgtaggtcatcagtctccaaataatgggagaaatgaagccccaattagatatttctcatctctaaatgaagcctctagttataagaatgggttacatctggttaagttgttggtcaaaggggccctgtgaaaaccccctaacaactcagacttttgctaaagctattggttgctctccacaaaatgattggtaagaccctattgttgcagacaacaactagacaactcattgaataatgagaagttgagctggtgcctatctagagactttacccctattgacatatatccattttactggaaggtattctgcatgctaacaaagaacataagcaaacacctacccagttacaaactcttctatcagaagttctagaacaatggtgacccaaatcttgtaggactaaccaatcaatatctaattgaattaaaggtccattccatgagatagaacccatttacaatactgcttgggtggccaggagcctgattacacataggacggagacatagaagtaaagcaaatactacaattctactaatggaacacagtaaataaaattactgctaactacattccgatatatccataggtcagtgtcttgttcagccatcattggagaagcttacacctacaataaatgggaacaaatagagacacccacagatggacaatgcagagtatgagatacattggaacagccaatactaaatgggatttccatcaaatccctcctaggggtcaggaatctctgtggatgaggaggcagaaagagtatgagccagaaggtatgaaagacaacaagaaaacaagcccttctaaacacaccaggactgaatacatggagattgtgccagcatgcacagagactgcataggtttgggcctgatatggttccagaacctagagaagaagacacaagtcctcattcctaacccagaagctatctccaattgctatgtgcttgcaactgaaaaaattaattttcttccatggaatcttactgggcatacaagccaatcttaagtccaggatccatgacctgcagtaaagggacaacacaaaatgaactcaaagggattttttatggttgtctcataatgctgtaaaaaaaataaacaggtcccttgcatatacattacggtttcttgttttgtgttgttatgtgatttctctgtgtgtgaattgtatatatgtatgtgtgtgtctatatatgtatgtatttcttgagcctttggctccttctcttctgtttgttgcttaattttttcctattctggtttgcttgattatatataatcattttattatgttattaatacttttaggtatcagattgcatcctaatggaagagaaaaaaatgtatggattttagggactgagcaagtcaaggggatcgaggaggagtttgtggaggggaaaccataattttaataagatgtattagaatttaatttcaataaaaatatttggcttattaattttctttccataataaacagtgaatcactgaatgtatttgagaaaattaatattttcccctaatcaactgattgtccaggagacaaggccaagaacacacattgattcaagcatttgatgcacttttgtttatcaattaattaagctgctgtcttataatcttggttgcagcattgtaaggtcactagaaaatacatctttgaattacaagaagaaccttaattggcctcacatgatactggaggatttttatttgaaatacaggctaatctagtcattattttctcatgacacattgtgggaactaatttaattggtagttacctgtcagacttatcttaagtgtgctcaattcttagtatgcagtcaggatggacctcttcatgaaattatgtgaaaatgtctgcagcagagagatggtttattgcgtgggactgtcctattaaacctgtttctatgtggcgatcctcacagcctatgtgtttgacctatgcagaacctcaagttccatcactcagggcagtgtggactaatctgtgggttgcagttgagagctgactctaggttcagctctggtactatataactatgagagtgtttgcacttttaatgtatgaaaaactatcttcttgataatttgagaaagaagtttcatccaaaaattatcttctatatcaagagttctttcatgtgagattcatttgactgaataaaattcattgatttcatgcaactttggcaagggagacttcttatttaaaaagaactaaaacagaagttgccttggtcccggcaaatactctagggtccagtagtaattagtgcttttgttctatgttgattaaaaccacaatttcattggtaagaatagtataaaggacagctagtttctatttcttcattaagattgacactatgtacatgaaagaaaaactacattaagaaaggctcaatacttcaatctgatcaagtagtacaagcaacactgtatgttttagtaattgagaataaatatgttacatgagttttcatttatgtaagtaattacaatagcattggataatagtcttgagaggttaactcaagcaataacttttattgtggcaattataacaaagcatagaaacagctttaattatttaaaaaatatattctattgcttatgcaatcacttaagcactttttaactgcaatggaatttctagttggacaaagaccaaaatatcttctagacactttttaaggaaaacttgattagagatcttacaaagttttcaaatgcaaatgatttgccaaatatattggttttattaataagtaagatttagttgtgaataatttcgtgaaatatgagcagcattgaattttgttttgtatgataatataaaattatctaagccattcaatagagatagttatccatgtctggcatagcctgcatggctttgcatttgacctgagtgtggcagggaaggaataagaaatgatagacgcataggcatacacagagaaaagttgagatcgggtgagttgtgtgcattctaaggtactagtaccaaatatgtcacaatggggattcagccagtaagagttcctccatacctctacatcatctcatgcttctaggttcctgccacgtttgagttcctgtcctgatatcctttagtattgaacagtgatttagaagaataaatcaaataaatcctttcttccccatgttactgtgatgatggtgtttcacctgaaataaaacaaaatgtgtagttaaagatgctttatttccgtgagatgctcatctgagcaagaatagagctatttcagctttctgtgttcagtgtttctcattgtattggtgtgcttgcataggtgaatattaagtcttgacttgtgctttcaacaccacatccaagtgagggtttcacaatgtcataccacctgaccatatcttcgccatctcttcaaaagcacttcagcttatgtccttcaacccagagttcatcttatgttttctaatgtattattccaaggatgtaactgttaggcatttgccattttgtgttacagttgtcttgacttcatgttccatgatggtatggcttatgtcaaatacttatgtttggaaaatcaaaccttgattttgaatggatattgtttattcatttctgcttatttcttgttctgttttctctaaacatgctttcttttatactcacatgataagttagattcttaagaataccagatatgtttaattctctatcttaatgagaattaattttcctgagggtatttaggattataaaaaatgtaatgcaggcataaaaatgtaacctattcctgcttttaaaaataaaaacaaagggacaggaaagataaagaacctgtgatcattttggatccaggaaccagaagagattgaattatgattcttagtaaacagttgtcttgattctaagtatacatttaaaattgttcacatgaaaacacataactaaacccattcctttgttttattttttatttttttgagtttgcagatgtatagtcaggatggtcatggtattggctacagaatatactctacgtatcacatctttgcctaaatggcaacaaccctagtgaagtactaagtcacttgagctatttaactcagactttcactgctgtaggattataaatcagattatgattgtctctgtactgcagaactggttcttctgtgtctctaatacaatgtgatttaattggaatcttgtcaaggtaactcttttttaaaccacaagaagaggtttggctgaagcccaaaatgaatagagtcatattttccttaaaagtggcatgttggtgatagaggttctgctgcttttcagtcaccacaagttcaaagtactgtcagttttcccagctaatatatcttattggaggggcaggttataagcatattttttaagtctctacttaatactgtgaaagacagaaattctaattttccaggaagaagcagtgaaaatagagatcatagcctggcagagtaagaaataagatgcctgactatcaaaggaatcccattttgtaatgaaagaccaccaggaaatgcagtaatgtgaatgtgaaattggacaaaccttcaaattgaacataaaggggtcacagctcagtacttctcttcactttataaagggaactttcagcttgtctgatgtaaataggatgacaagaagtaatttgtattgttcacatctaacatttaataactcctcagagaaatgaaagctaatttcatttgtgtttgcattctttgcagacacttgtcacaagttgcttataaatttgtaaggctacttctcaaatatggagaattagacactgagtgtgaaatcatagcaaaagttattagaatacttaaaagtccgtgataaccgatgtataaaagtcgaagatataatttaaggaatatgtactcccaagagcaatttgtaatttatttaaaaaataatgattattttaagaaatcatttgccaaggaaagggatacagttttattgccaaagtttattaaaattaaaggttaaaataacttccaaatttatggaaattttgttcaaatggctgtggggtatagggctgtcactgaactctgaaagctaaggcaggaggattgcaaacttgaggtcatcctgggttacactgtaatatgctctctcataaactcaatgctagtgctgaagctgcttgctagagagcttgcagagtatgactgggcttaatctctaacactggtggcaggaaatggagagatagatatagagagataacagatatttaaatacatgatggacagatgaaatataatagataaatagatagatacatctatagatagagtgattgatttcagttagttctgagttcttacatgaaagaatatttgcacaaaattgattttcaaagagcttcaaaatttcaaggacattctgcatctcttaatattcagttaaagatatgcaaattttgtgtcttcatttgacacaggatttcaaaactttccttctttgtttggatgtcaaaaagagacatgagtgttattttttattgtctttataaaatttccttaaagtctttggacctttggccttatctttgattcttttttttccccgagattattttttattagttcaaattagaaacaaggctgcttcacatggcaatcccttctctctctcgctgtcctcccccaaccccctaccagccacctatcttatccacactctgctcctcagcgagggtaacaccctccataggggttccccaaactcagtcatatcatcctgggcagggcctaggctctcccccatgtgtccaggctgagatagcatccctccatgtgggataggctcccaaagtccttcttacaccagggataaacactgattcaccaccaggggacctcttgaggagtgctggggcctcctcattgacatcaacattcaggggtctagatcagtcatgtgatggcaacccagacatcagtctggggtccatgtgctcccccttgttcaggtcacttaattctgtaggtttcagcagcttggtcctgacctctttgctcttcattcctccctctctgcaactgggttccagaggtcagttcagggttttgttgttggtgtctgcctctagttccatcagccaatggatgagggctctaggatggcatataagacagtcatcagtctcattataagggaagggcatttagggtagcccttccaccattgccaagattgtcagttggtgtcatccttgtagatttctggaaatctctctagtgccagatctttcctcaaatctataatagctctatctgttatggtatctctcattgtactctcctctattctcaccgctactcaaccttccttctcctcccttttctcctctccactcttcttctccccctctcattctcccagctcccactctccaaacctcatgctcccaattagctcaggagatgctaccccttcctcttctccaggctacatgaattcttcccttagagtccttcttgtttcctagttcctttgatgatgaggattgtaggctggtaatcctttgctctatgtataatatgcataaataagtgagtacataccatgtttgtctttgtgtggctgggttacctcactcaggatgatttcttctagttccatccatttgcctgaggatttcaagattccattgcttttctgctgagtattactccattgtgtaaatgtaccacattttctctatccattcttcatttgaggggcatctagcttggttccagtttctggctattataaacaacactgctatgaacatagttgtacttatgtccttgttgcatattggtatatgttgtctgtgggtatatgcccaagagaggaatggctggatcttgaggtagactgattcccattttcttgagcaaccaccatactcatttccaaagtagtcttacaagtttgcactcccaccagcaatggaggagtgttcctttttctccacatcctctccagcgtagactgttattggagtttttgatattagccattctggccagtgtaaggtcgtatctcagagatgttttgatttgcatttccctgatgtctaaggaatttgagcactttcttaagtgtctttcagccattttagattcctctgttgaggattctctatttctgcaccccactttataatttcctttattgttgttttggaaactagcttcttgagttcattgtatattttggaaatcagtcctctgtcagatgtgaggttggtgaagatcttttcccattctgtgggctatagttttgtcatactgactgtgtctgccttacagaggcttctcagtttcaggaggttccatttattaattgtagatctcaatgtctgtgctaccgttgatatgttcaggaagcattctcctgtacaaattcgttcaagggtatctcccactttctctgctagaagattcagtgtggctggatttatgttgaggtctttgatccatttggacttaagttttgtgcatggtgatagatatggatctatttgcaatcgtttgcatgtccgaatccagttgtgccagcaccatttgctgaagaagctttcttttttccaatgtataaatttatcttctttgtcaaaaatcaagtttttgtaggtgtgtgggttaaaatcagggttttcaattcgattccattggtctactgtctacttttgtgccaataccaaagttgagtattgttctttcaaggtctatgaaaaactgtattgggattttgatggggatcacattgaatctgtagactgcttttggcgagattgccatttttactctgtagatcctacctatccaagagcatgagagatctttccattttctggtatgttcttcaatttctttctttaaagactcaaagttcttactgtacaggtctttcttttttggttatcatcaccccaagatattatatgttgcttgtggatattgtgaagggtgatgtttctctgatttctttctcattgtgtttatcatctgtatatagtacggctactgaggttttttttttttttagttaattttgtatccttctattttgctgaaggtgtttatcagttatgggaattccctggtagagtttattgggtcacttatgttgactatcatatcatctgcaaatagtgaaagtttgacttcttcctttacaatttgtatccacttttcttgtcttattcctctagctagaacttcaagaacaatattgaagagatatggaaagagtggacagccttgtcttgttcctgattttagaagaatcactttgagtttctctccatttagtttgatgttgtctgttggtttgttgtatattgcttttattatgtttagatatgttcttgttattcttggtctctccaagatctttattgtgaagggattttggcttttgtcaaaggctttttcagcttttagtgggatgatcatgtgttttttctttttcattttgtttatatggtagattacattgatggattttagtatgttgaactgtacctgcatccctggaatgaagcctgattttccaatcaaatggacccaagaaacaagcttgtctagcaatcctcatatctagcaaattagacttcaaactaaaatcaatcaaaagagatgaagaagggcatttcatactcatcactggtaaagtccatcaagatgaagtttcaaacctgaacatctttgccccaaatatgaaggcacccacttaacccgtacacctatgaatacctgatttttaacaaaggagctaaagctatacaatggaataaataaaacatcttcaacaaatggtcctggcataactggatgctggcatgtagaagactgcagatatatccatgtctatcaccatgcacaaaacttaagcccaaacggatcaaagacctcaacataaagccagaaagacagaacttattagaagagaaagtaggaaataccctagaatgaattggtataggagactacttcctgaatataacaccagcaacacagacactgagagcaacaattaataaatggcacctcctgaaactgagaaacttctgtaaggcaaaggacacagtcaacaagacaaaacaacaccccacggattgggaaaaggtatataccaaccccacatctgatagagggattatctcaaaaatttacaaagaactcaagaagctagtgtccataacaccaaataatccaattagaaagtgacatacagtactaattagacaattctcaatagaggaatctaaaatggctgaaagacacataagaaagttttcaccatctttagccatcaaggaaatgcaaattgaaacaattctgagataccacctcacacctgtcagaatggctaaaataaaaaaaaaaacactaataacagtctgtgctagagaggatgtggagaaaggggaacactcctgttctgctgttgggagtgccaacttatacaatcactttggaaatctgtatggtgatttctccagaaaatgggattcagtttaccacaagctccagcaattccactcctaggcaaatacccaaaagaagcacattactacaacaaggacatctgttcaacgatgttcatcgcagctaacctggagacaatctagatgcccctcaactgaaaatagagaaaatgtggtgcatttacacaatggagtactactcagtgggaaaaaaaaaaaaacaatggaaacttgaaattctcaggcaaatggatggaactagaagaaaacattctgagggaggtaacacagtcacaaaatgatcaacatggtatgtactcactcatatgtttattttagatatatagtaaagattaccagcctacagtccacactgccaaagaagctagttaacaaggagaaccctaagagagacatacatgttcccctggagaagtagaaagggacaagatctcctgagcaatttgacagcacagggagggggaggggagagggaactaggagaatgtgaaggtgagaagaggaggggtgaggaagacatgatggggcagggagttagagttgagggaagaacagaagagagcaagataagagataatataatagaggggtttaaagtgatatgtctggagagctacaaagatgaccccaactaacaatctaagcaacagaggagaggataccttaaatgtcctctcctgataataaaattgatgactaattcatatgacatcatacagccttcatccaacagcttgtggaaggtaagctaaacgttgaactgaactggagtccagttgcagagaaggaggattgatgcacaagcgggtccacaccaggctgatgaaacccaaagaaacagctgatgtgaacaagggagagctcttggtccccaaactgatatctgggaaaccagcatgggactgatccagaccccctgaatgtgggtgtcagtgaggagacctgggaaatctatgggacctcttgtagtggatcagtacttatccttagagtagaaatggactttgggtgtccattccacattgagggatactccctgagcctagacacaagggggttggcctaggccctatcccaaagaatatgacagactttgaaaacgccctatggaaggccctaccctcccttgggagcagaaagagtatgtgataggtagggtgttagttgggggggtaggggaggaggggagggtgagggacctgggattgacatgtaaaataattttctttctaatcaaaataaaaaagaaactaaaaaggatatgaatgataatactttgtaagaaattaaattcatgtacttcagaaatgcaagtaaaaaccataatggataaaaaagaaacattactaaagttcaaacctcacataaaacctcacacacttacaacaggagacttcaacaccctgccctatccttgattgttaaatgatttggaacagacttactatattgtagagttcttcctgctatttttcttcttgtatcatcagattataaggtattttatttacaggacctaatttcaaacatcagctgaactccctagacattgttttatgaaccatttactttgtgtgtttttgttttacagaagttttttgagagttactggaaggatttttgtatctatgttatgttgaagaaaaattttgctcaatagaattttttaaaaatatgtgaaactgtatgaaatttattttacatttctcctgagttcctgtcctgtataaagagaaaagatcatttagttaaggaaaacacttcatttacttaaggctcactttgtcccaaaatctgggtaataagatacatcattttcatagtctaaaaatgttcttattcaaatatgcaattatagattagttattatattttataattccctttaaatcaacctaactattctcataatctgtagcattattaaaaattgctagctgttctaatctgccagcttgtttattttcattggtgaactgaaactgttggcattcagagttgcatttttgatcttaagaagatagttaaatggagaggtgcatgatttccttaactagaataccagaaaagtgaaagaatacaattcctattagatgtgtcttgaaggacatgtccttgtaggggctggctacatcctcgtttttatttgctttttgtcaatagtctccctaaatagctacacacactcatgagttcaggttccagaggcttcaggcaatctgagtttctttctctctgtctagaacttgtctattcttattatttcaccaattcttattaggccactccacttcaatgttttttgagacaacctaaagttaatgttttcataacccccctttccaatagtctgattaggtcctcctcacatgttttaaattatattaaattctgataaaatacaccaatatagtaaagttagaaatgtagacctcacctttggtcttctttcctccttcctccctccttccttctttcctttgccttttcaaaatggtagtattttgatgacatttataagttttttatttaccaagtactgatctattacaaaaggttccatagatttccgaggtctccacactgacacccatgttcatagggtctagatcaatctcctgagaaaactgggagcatgaggggaggggagagggagctcggggaatgagaaggggagaaaaggaggggtgaggaggacataagggagcaggagttgaggatagaatagaggagagcaagataagtgataccataatacagggagcccttatagatttaaagagaaatcaagctctagggaaatgtctgtagatctacaatgatgacaccaactaacaatctaagcaacagaggagaggctaccttaaatgccatcaatctcctgataatgagattgatgactgactttatgccatcctatagccttcactcagcagctggtgaaagtggaagaagacagccctagctaaacactgaactgaactggaatccagttgcagagagagaggattgatgagcaaaggggtcaaaaccaggctggtgaaacccacagaaacaggtgacctgaactagtgggaacttttgtttcccagactgatagttgggaaaccaaaagaagttttactgtttgtgaatgaacaaggtgaatgaacttggaggggatgctatgtgaaataactgagtaagagacagaaatatcacactttggggaatataactgttgaattcagaagtggtaaggacaatagtaggtatcagaaaacagtggatataggaaggtaagggaatgtcaaaagggccaaaaaaaggaaggaaggaaggaaggaaggaaggaaggaaggaaggaaggaaggaaaggaagaccttcagttaactacaaggactaagttcatgtgatagatcatattttgcagtgactattaaaatttataaaagaatagcatttcagaagcctgagaaggttcatggaggataaacacagctcaccccctggccccttagtgttggggggtggttaggcagtattgaacatgagcagccaagggtgtctgtattaatgtctgtggctcctgttaccatgaagtgagctgtcatcaatgaccaagttggtgtaaagggatgctcccccacaggggccatgctgatctaataggcctgtgctgccacctgggaccatgggaccatgctgatccaggaggcctgcactgaaccaaggcccatggtgacatctggcctagaatggttctgtgctccatggccctgctatgtctaggctataaattgacatctgtaactcctgtagccatcaagggtcatgcagaggtccactctctgggatgatacctgaggccatgttgatctctgagggtcaaaaatccttcccaggccatatatcctgggaggcctgaacttccacttgggaccatggtgtcttctagagtcatatctgagtctgtggccctactatgcctggggtctgtgttgatgtatattactcagtttaccactgaaagatgagtggatgcccagagtctgagctgccacctggggacatgttggcatatgaaggacattccaccacttcagccatgccagtctgggtgatctgcaatgtcaactagggctatgattataggtcttctgccaaggactatgtctgtgtctgtggtcctacatcagcctgagtatgtattgatgtctgtggcatgtgttgccaccaaagaccatatggagagcaagatctgggctgcctcctgaggtcatgttgatgtcagagtgttgtgccatttcagggtccatagatattggagtgatatccgttaccattcagggccatggtatcccatggttctgagctctggccagaaccatgtctggatccatggccctgctgcagccaggtttctgatgccattaaaagccaggtagatgttcagagtctgagacaccatcttggtccaggtgggtgttcaagggccacattactcctggatccatgtttgtgtgaatgacctgtgctcccaaccagggctatggtgacacctgtgtttcggctagtgcaggaccatgtctgggtgcccctgttgctgacttggtgatgtcagtgactcctgctgccactgaaagcagtgaggatagggctgcacagagttggccctgcccctcaccaactatagcacttgataaaccagcccctacatgtaagagttgtccctgttggcagaagtgaggcagtggggaggggtgcaagtgagttggccctgaagatacaatgggaggagagctgggccaatgtctgtcatatgatggcatgggaaaagaagagatacacccttaacctttcccctcatccctggccacctgcaggtgatccaccctaatgaatgtatgtggaagatctgaccccagccctcatctgccatatggtggagtaggcaaggaagagaagacctcccacctcccctgacccttgctgtctctggctggtaggagagctggctctgagatcatgagagtggggaaatggtaatgctccttacctgggcagtacaataggactggccctcttggcaggtatgccagcctggagagcaagaaagcatgagtgctgaccctgctcctcatctgccatgtcgtgacatggatgacagaaaaatgccttcccccaccctctcacctttgcagcctgtgacaagtgggaaagctggtaacagggtgccaaaagtggttgagctgatcctgttctcaccgattgcaggccattcactttttctgggcaaaacagtagagctggccctggtggtgtgagcacaggaaaaccagaccctagcctgtgagaacaggagaactggctggactccctacttgctgctgcactgggtgagctggctggggcagtactaaagagcttgccctggtagagaagatgagggaaagctcgtggaatgagcaaccctgctactacccaggcccagaacctgggctacaatttagcccaccacaacacctacatcatctgtgaactgctggagtatgtgaagggaccacagcagcagatctaaagtgacaggttcttcataacaaaggaaaatcacaggatatccagaaaaagtcccagtggggtcccagtatcaatagtgaaacagaagctagaggccttgagtcagactaaaatccattgcaatgaacacttacaagtaaagatgtatggactaaggggtatactgtgtgatttactgggccacactacatcttttatgctgatatgtttgtttttgtttttgtcatttgtttgctttttggctatacttttaaattttgttttgttttgggggaagatgtttcaaggtcagagggtggaggcaggggatggagagatgagggatatctggatgtatgatttgaaatccagaaacaatcaataaaaagttacttttaaagaatagagtttaaatgttttaactagaaatgtgatttattgtcaaatgagtcgagtctttgtagtcattctacatgtacatgataaagttatattggaacaaaatagagaaatttaagacttatggagaaagttaagcctccgcaagtatccatctgtatatctatcccttaaatctatcattttcattggtggattactgtaaaagtattccatctttatctctccatctattgacagacacaggttctttgtggcacttgtctggacactaacatttgttcgcttaccttttctaatttctaaaggactaatttgtacaggactaatttctcaatgaagggatttaagcaacaaccacagagagatgccctttgttgatccattaatagaacagttttctctctcaaatttgataaagtttgcatcaagcaggcaaatggagacaagtaagaggaagaaaggaattagaagaggtgtgatgcacagatctctatggacaccattgatcacattgatgggacttaaacaggaggaattcaactaaagagcacagtgtgtttctataacttcttcataatgttttaccttttctaaataccacaagtaaaatacaagtcacaagaacagatacctatatgattgtgcttacatatgcatttcaatgtattcattcatagtttgaatagtttattttgtgtcaaagtaaggacagaaaaaaatcttagaagttatagggaagggctataattagggataaaggaaagtaaagataattttttcaaactaatagcatatttccatttttggaggaaaatacttcaatataagttactttatcttataaattataaaatagttataaattgctgagtccagaaggtttaatgattgtgttctctctgctcagacctctacagacctcaaatgagtgcagagtggctgacacaacatcaggatttagaatttgtatttgcatttttctacactatgaataaagcttttattttcaaaatcatgaagcttatatatctgatttcaaatagctttagttacatggtctttaatttttgctgtaaccacagatctccaagacagaaccaagtgatattagcaatgcaagcatataagacatattctttatctttttggaaatgtatttgttatctctacatgttaatatttgaacacagagagaggctctcaatgactttcctagcaaaaattactcaaagaaatacccccatgcccaaatataacatcatgccttgaaatcacttactttttaatatttggtgatatttattcatcattaatcttaattgtagagtccggggttaattagccagaattattcccagaatatcacaaaattccatgtggatatgtattgcatagaaaaaagtgtgactttatgagtcatgcaaatttggagataattttaaagatgtcttatatttaccaatttaaaagacagaatccaaatccttactgcatagcacctaatgaaagcacagtgattatatttggctctctaaattagtatcattacctgaaagcctgaatgcccacaagatggggttgtgacaacttgattgtgtttagtcattttgtaaattaggggctgtgtttgaaaactttgaccaagtgagattgacatgagcctctcaggcaacagtgggtagagcagaaggcagatcacattgggctgccagcccttgacaggcttgctttaactttctctccctgaagttccatgtcttttattctgtcttcactgaaatggtgacacaaaggttatgacaagcatgtgaaaatagctagtgactcattaatgtctgcgaggactgagcatcatggagcagcacagggcggcttcagcaagtgcctttcattcctcctgcatgttgcagccaatctcctgagctgtccagagtgtcatattccctcagtgaaacaagatcagtgcattaatatgctcttctccctctaagctcatagagacttgtcacattaatattttgcctaaaccaactttccctgaaatgtaagaatgcaaattattcacatcttgaaacccttctgtaggctttttttttccttttaaatctgtcaactttcaatttacacatatattgaagtaatggacactcttaacaaacaggaggttttatttttttattatcatcaaaatggaattgaagtggcagcactgaaaagggatttttattaactggttcttatagttaacctcttttagagtactaatttatgaaccctgaaaaaaagctctctccaggttcagtcctattttaatgcttttaactatttctgtttattttcctaagtgccatttttactggtttatatgtcaatctacatatgtataggttgtataccttatacctctaacttacagttttttttttcttgcaggacttgaaacatgatattttcaataataatagctgtgatcataaagataatacagacttttggggcaaatgcaccaatgcacacagcaatggttttgaatttagaagacagaaggagagaattttaaggagtgatatacaatttctagagacaaaagaacttaccattgaaggaaataaaagacagttcatatcattttagtcacatttttcttcacatattctagttacaaacttattaaatcgtcttgcattaagatagtgacaatagttgactcattggagaggctgagaagttcatagttgctaagtctttgaggctgtttgactcaacactgggaatagtcacccccagtagctatctgtcactggaaggtcaacaatgttgtagttgttcagtccccaaaggtgggcacctgagcaatcccattcaggcaccaaaaccctggaagtttatttaaaagtatggaataggtattctctcagcagagaattcaacttacatttacaaagtcctgtattaagttcccctcacatacaccatcatcattattttctataatttctgtcttgaaaggggttatagcttgcagaattttattctcattgatgttttaaaataattttattcaatgttttgctctttaatatttgcattgctattttagctgatttataattttacaacagattgaaagagaaagtcatttacccagagcttattgtgatggttgcctttcactgtctacttcagtggattttctattcacctaggggattgaggcacacattgggatatgtctgggagggtattaaaaacgcagaggacccactctgccactctgaagatgtcagttccatcattccacaagaaccagaaaggaacacagagagtggaagcagaaagccagttaactgaaaagtaaaagaagaaaaagccaatagtcaggcagaatcccttctggaccaccaagttgtctactaatgtggcccagcctgacttgctttccataattcactgaaccctctgaaaccaggaactaaaatatactcttcctcctttaccttgtacgtgaggtatttttctcacagtgaagcacaaaactatatacttatttcactgagtgtattaataaagttaacaaatgtttcaataactagttattaaaggtagcgatctatttaaccatgtgaacagcagtccatggagcactttgtagaactatttctgattttcttcacagtagttctaagatagattttgttatgctgactttgtgactgaagatgtcttatttttcagacatgattaactagtttacttaatccacaagttagataaagaatagaaggttaaaactcctaatcacagaacaatagagaatgtgccagtacaccttggatatccatgtgactcacaagtaagtaaactcttctatcttttgtacagtagaactcacattagtgcatatttattcattttaaatttagtctttaataattttatgtatgtatacaattaaatatgatcatattcatattacatgtctcctttcatctctcctcagatgtccacacacaacctctcacttttatgtctttttaaaataaatgtcactaaatcacatttgtgttgtccagtttcacatgaccatggagtcatttactgaagcatggagatcttgccagtggggtcacatctccagaaaagaataattttcttttcttcatggcctaacaatggtcaatagcttctcatttgtggatagggtcttgggagctcctcccagatccatacgcaaactgcgattcggctgatcttatataaatcccatacagttaataacagtggctgtgagtccatgagtgcagttgcatgggagtcataatgcaaaaggcagcacttctcttcactcctcctcatcctctgtgccctcacatttgttctgtctactctttcatgatgttttctgagtcttagcaaaagtatgtcagagatgtctgattttattagcataaaagtatgatgtatttgactgatataataaatacatattagtgttaacttttgtcattttaaattctatatttagacacaatatgtcatttccttttaaagaaatgttacatctttagttcatttagctgagatctttttaaatgctgagggagtcaaatctgcaaactatattctatgaacttccaaaacatcacaatgactgagaaggatacctaccatctccatcctaacacatgccacttgtttaatgtgaggaaagttgagctctgagagattacaaagttaaattgtgtttcccctcctcttcactttcttattgattttttccagattttttatttgaattagaaacaagattggtttaaatgacaagcccagttcccttctccctcccgtcctcccctaccactgcccccaactaaaaccctacttatcacctatcacatatcctttctactttccctggatggtgaggccttccatagggtgacatcagagtctatcgtatcctttgggatagggcctaggctcacccccatcattattagaactccctgaggattgtccccagctactgtcacatcagttaccatagttactatgctagggataagtactgaactactacaggaggtccagtagatttccgaggtttcctcactgaaacccatgatcctggggtctgcatccatcccatgcttgtatcccagctatcagtctggggagcaaaagttccctgatgttcaggtaagctgtttatgtaggtttctaaaatgactatggctgaaaaacacataagaaagtgttcaacatccttagccataaggcaaatgcaaatccaaacaactctgagataccatcttactcctgtcagaatggccaaaataaaaaacaccaatgacagttcatgttggagaggatgtggcaaaaggggaatgcttctccactgctggtgggattgtcaacttatacagccactttggaaatcattatgaagactgttcaagaaaatgggaatcagtctaccagaagacccagcaattctacttctaggcatatacccaaaagaagcacattcatatagcaaggacatctgttcaatgatgttcatagcagcattatttataatatccagaaaatggaagtagcctagatgcccctcaaccaaagaatgtgcagattttagacatagagtaaagtattactagcctacaattcacactgccagagaaggtagtaaacaaggaggaccctaagagagacatacatggtcctctggagaaggggaagacataaagatcccctgtgcaaattgagagcactggaagaggggggtgggaggtaggagaatgagaaggggtgaagaggagggatgcagaggacactctcttattgttacatctgattctcatcttacttctcatcctcattcctttgtgaacagtactgaacacagggcctcaagtaaagacacttaattttgatgtctcaatctcttagaccaatggttcctgaaccaatacttttcatttaacaacttaaagcaatagtcttttgtgttgtgtgcatgtaaggatcaaccttgttcaaatatttatttctatggaaaaactagtttatttcaatcagaataatgtgactccctcaaagttaggtttttttttaatgtgaatgtgttcctggttctctgtgatcatatgtaaatcacttcagctttttgactctcagttgatatctgtcacatgaaagttgactatgaactttctgttccttcatattgtcagtttatatagtgcatgatgtttcaaggccagccatataaaagccaaatgaagaggagattcattgtcagattctttttgatcctttttgtacttgtgcatatgcagcactgagacagcctgcatcatccttgttctagatgagtgcacactttatgtgcaggtctctaacttcagaagtggttctcaacctgaggcttacaaactctttgatgtttaaatgaccccttttcagaagtaatatatcagatatcttgcatagctgattttcacgttaggagtcataatagcagcaaaattatagttatgaagtagcaatggaaataattttatggttgtgggtcacaacatgaggaactttagggatcacagcattaggaaggttgagaagcactatctacagggttgtgagaggagaaggggttgttctgagagcaactagacttctaagtccaatcttttaatgcttctctggtggagagccttatataatatcttacctacaaatgaaaatgttagcatgttattgggtgtgacgcttaatggaagtaattaactaaaactgcactgctacagagtaatcagcttttaactattaataaattgtgtgatctgctttgaatatgaattgagtcccattgtcctctagagagaaattatgcaaaatgttcattcactttgtataccttctatctgatatttcactgaggttcatctgaagcatatcagcatatagacacgatctttatctggccatccatttgtatgcaaatatctctttgtgaccctttctttcttccttccttccttctttccttccttccttccttccttccttccttccttccttcttctctctctctctctctctctctctctctctctctctctcttcctctctctctctctctttctttccttctttccttccaatactgtcacaggccactatcctactgactaaccactaaatagtatatgttgtgtactcaatttatagccaagtaactgatgtactggagataaacacctgttatgggtagcattgaaacaaacattctgctttcataagtgcaaagcttgtgtcaagttcaaacaaaagcactgacacacatcaacaaccacacttacatacatgtgcaaaagtaaccccatacagaaaatggtaaagaattgataaacattatctgacataatctttccaatgaaatatgaattaatcttttatattcatgaatttgaacatagatgggaaaatatatattaattaataaaatgcttgtcttactaaaattaggagctgagtttcatccctagaacccatatttaaaaaatcaagcacaatggcacatttttataattcaaacactaggaaatctgagaaagactgatctctggaactcactataagctaatccaggctctaaataaatcaatctcaaaataaatcaataaaataaaatggatgttgcctgaagaatgacacttgaagttctcctctgtcttccatgctcatgtgtaaatacataaacattcattcctctaccacccaataactgagaggacaactgggaacatttacttcaaacctgtacctaattctccaccacaatttactgtacctttaaactgtgaggccaaaataaatgtttcctaccttaagatttttcatcaggtattatctcataacaatacacaaagtaactggtgtagatgtatagcatgtctaatgagctaagtgtaaaagatattgttatgtacctttaaaagttgatgtcaacattcctaagattaatgaagagattatatcgagttttgttggtcagtgctagaacaagtcttagtatctcttgcctttgcttttctacaagggtctttactatagcttgatacttcctaaaggatcaaaaatataaatcagaagctggtgccacttagaacttcatgatattcataagaaaaaaaacaggatttgatttatgactcaaatctttgatagcaatatatttgaattttaaatgataactattgtatttctacataacatatatcatgagcaatctcagatcagtgaatcatatggtacagccaggagacgagggaaagacctaagtcaattaagtataaatctagaggcagacatgtgattagaatgtaaaacctcatcctctgtccttattgttgatcttggggactctccaaatgtataaagcatttgccaaaaaaatttgcatagaaataatattcatttgtgcttgaagcattcattagttactctgaaatttctttgagtatcaagcacgtgtgtaaatgagacgagatatgagagcagtgggcgatgtaatccaattatcccaggaatattgcttgccctcagcagagcagcagcaaagctggatcctgaagtcagttcacatggttgttgaatcatttttattttggattttgggctgatcattaccttacaagcatttaatatttggctaaaatatattgcatttccccttaaatatgatatacattgtgtttgaaacatagaattaatatcataatttaaatttcttgattatagcaagactcccttcacttgactggcaatcctctgtgtgtgagctcatttctaattattcacagattccatcttataattcaacatcctgtttccttctctctacattcctagccaacttgcatttgttttgtaagtgacagcatgcctcaacacagttttcattgtttactgattcatttattcaactgagttacagggtgtcagtgaactgacaaggagatgacatgtaatgctggcaggcaagtcatgggaagagttgagggaatattccagattgttcaattttgggcctctatgttccccaatcaatatcttttgctttctaattgttcttggatttatccatagtgacattatccagagttgtacacttccatctgtgcttataattgcaattttgattttttatttagattataaacctattccagctgggtttcctggtgtgcttcatattctgaatgctaaaaatgatatcaatgtagtattatgaacatatttgtgattttaaaagtacttctgcgctctacccaaggacagatgtttccatttacatacttaaaaaaccagaaaattgaagttgttgatgaaaatcgccatgtagcccaagccaaattctttgaatgaactttgtgaaaacatagcattctccaacaggtaattcaaggataccagtctatagcttttatctttaaaaagaaaatgaaaaggaaagccatatatttattatttattgatgtatttaattttctatgtggggaggggcacacatttgtgcttttgtgacatggtgtgcttgtgcacaacaaatagatatggaaagtcactttttcttcccatcacagtgtcccaggattaaacttagatcatcagcctaagaaacaatactccctattcattgagcaataccacagagcagtaaaatccttagtttttaaagatttcatttattttcatttatgtgtatgcacatgtgtgtgtatgccaatagaggccagaagagagtatttgatggatcaggagttacaaatggttgcatgctaccagttgtacattctgggacctaaactctagtcctcagcaaaggcagcaagtgcctttacctactgagcaatctttaggaaacatttaattttgtttctaggaatagtctacttattctcttttcttggcagtttcttagtgccaagctagtgctggctggctggtgactaaatacatgtgtccaagatatcatttgtcctataacaacttaggtttagttgaatagcaagtagtgagtcccattttctaaatggtcatgttcccctagctttctgtcagcatctcacttctctctcttgccattttctgatatttgtgactagctctgttcagtaattgtgagagtgcttgtcagcctaggttgaatgtgtcagtgtgaggctggccagcttcttttactccccaccaccgagctttccaggtggggattatcctatcagcctggctttcaaattgaagacaatgacaacatcaaatagattccaccctatatcctagctgagtgtataatgctagaaaaggtagagcatgtttcactaaatcactgagagatagattgatggatactgctttttaaactcagtaatcctgatggatacagaaataaatcctttaagggaatttctaagtttatctgaaaggctcatttggaaaagtggcagaataaaaatgtatttatatattagcatgtatattagccttaacatgtatatcaaaatgtttgttaatataaaatatgattctatatgatacatatgcataggaaatatatgttgctatacagacaaaattgtaaatattcatgtgaaaagtagacaaaggagtatctaagtgtgttttcagaaattctgatacactgggttcaattcctgctacccacattttggaagctcacaattaattccaattgcttggcctctgtcatgaaatacatgtatgtgtacatatgtttaaatacatacacacacacacacacacacacacacacacacacacacaacagggattacatacatatatgtgtgtgtgtgagtgtgtttttgtgtgtgtgtttgtgtgcatgtgtacacatatcaataaataaatataagaaaagaaatgaagcaaaccttattatgcatatattgcacagagatataataaatacattttaattcatgaagaaaatgtggtacattcaaacagtggagtattactcagccatttaaaaaacgaaatctgcagataatggatgaaactagagaataatcaccctaagggtggtttcccaaaaccaaacaaatatggtttgcattcacttatatgtagatattagatgttaagtcaataaaaatcaagctacaatctctataaccacagagggtaggtatcagtaaggaactagaaggtatagttagatttaattaggaaaggaaaatataatagatagttatagatggatgggaggctgatacagaaggaccatataaggagggagaagggatggtgggatgatggagggaatatggggagagacagctaaaattaatcatcatctaaggggtagtatggaaacctaatacagtagaatctttttaaatatagtcatatatgaaggtgatataaatgaaaatgtcaaataggtcagtattatagagttccaactggccatctcatcacgaaatgtagcttccaatctggggactgcaatacatccacttgtgttgttggccaaaggggcctataggaatccccaaataatccaggctattgctgaaacaataggttgctctccataaactcatagcagaccctatcactgaaggaaaacaccttcagtattccttgaacatgcagacattgaatgaatgcttacttagagccttcacccctatgttcttgattacgtggtacaggaagttactctgcatgctaccacagataaatgcaaacacaaaacctgtcacaaaccctttgatctacaatgctgtctgacttaacaagatatgccaggacaatggtggcacaaaagcatttgggagtagccaaccaatacctgacttgacttaaggcccattctgccagagggaacccaatccatcactgcttgagtgcccaatagaatctagatagccctggaacacagataaaactaaatgctactggtagaagagaatcaaatagaaaaacaagaacaaaatcaaaagaaagcaaaagcatagggataaatgacccctaacgacattctgctatacagataagtgactttctatactgtcatcagagaagatcagtagatggaaaaatgtacagagatcctaatgacccaagttccaccagcagttatgccaaaaagaaaacaaagttgtagtgtttaagaagttcatctggagagctacaaagatgacacccaccaactaacaatctaagcaacagaggagaggctaccttaaatgccctctcctgataatgagattgatggctaattcatatgccatcatatagccttcatccagcagctggtggaagtaaaagcagacacccccagctaaaacttgaagtaaactgaaatccagatgcagagaacgaggtctgatgagtaaaggggcccatacaagactggtgaaacctacagaaacagctgaccttaacaagggaaaacccttggtccccagactgatagctgggaaaccagaatgggactaatccagacgccctgaatatgtgtgtcagtgaggagaccttgaaaacctagagggcttcttgtagtggatcagtacttatcaataccataggaatggactttatgagcccatcccacatggagggatactccctgagcctagacacaagtgggttggcctaggccctatcccaaagaatatgacagacttgaagaccccctagggaatgcctgaccctcctgggggagcagaaattgtatgggatgggtagggcattagttgggggagcagggcaggaggggttggagaggacctgggattgacatgtaaaataattttctttgtaataaaaaaggagaaaaaagaaaataagcaaatactcatagaaaaatttaaaaaagaaattccagaattcttaatatacatttaatatgaataaatttttaggaattgggtgtgtgctaagaatgagggagaacactttaaatccctgcaattttttatggaacttaagatatggctcaaaagtacagagttcttcctgcttttcagaggacatgaggttggttcccatcattgatatatgatggctaacaaccacctataattccagctccaggacacccttttctggtgtggtacctgagcacatgtgggagagactcacactgatacacatgtacatataaataaaaataaaataaatgagttcatgttcatgatcgaggtccatatgggcctacaattctcatcacttagtactttctatttgcatttttattattttataacaattttaagtgttaatatattttgtttatgatcttccctaacccaagtcttccagatcctctctcactccctacccatccaacttctaagttccttctcaaaagcaaataaaaacccaatacagtaacaaatcctcccctaaaccaagaaaacaaaataataccattgctaaaaagaacaaaaatcaacttttaaaatgatactttattcaattcaccttgaaaagaagacattgtatggtaaggattattataataatagaatgaagccatgggcagaaagaaaaatcctataatatttcaaatgtgtaacagaaagttattgagtgtaccatgcccagagataatctataaccaggtgtctgggcaccttatggtcagtcaagttgacattcaaaattccatagcataattaggttggtactatctcatttatgactccaaattagagagaaaattgcttctacagcttcactggttcgagtttccctagcgaatacagtcctgtaatcctgtattagttctacctgaccacaggtgggcataagtaacaatgatttctcatcaaaataggatgtctgtcactaagtgataaattctccttaaatggaaagttttatagatatttattagattacaggatagtaaaaaatctcccctctgtgttcatgaaacatgcacttcgtaatgaatgcacagatgaaacagccaagatgatatcagtaataaaccctagtaggtgatttaaagtcactgagtagtgataggcattgtagtcctgtcagctgagctataaaggatggtgtggtacttctgaactccataaatcaagacaggaaactcatttaggaacactctttaaccacccagacttcctttgcataaatgtaagagactccagggaagccaatacattagtatccatatcctagagaggaataaaaatgatttggctagcagcatacaaaattggggccatctgaaagattcatagatctgccccataactgaaagccgtccaactcattttccttcatgctgtgaaagctcacactgcagagaaggctattcctgtaactgtcactaaataacatgccccatgatactgtaactaagggataaaacaggctgtcatacttcaacatggaaccaaaataagataaaaatataaatagaaggaaagtgcccttttatacatgtgaaatttgagttattgagtgttatccttggacagctttttagatcaatgtgatgaagtattttttttttagtaatagacattgtatttgtcttatgtttgcaatactcagacttaattcttaccatacttttctgtgctcataccatgcagctgtaaattggaataaactctaatcataagtgtttgaattctgcctcctccttttctggtttgagtcacataaccattaaaatagtaaaataaattaaaatagcatagcaaaaagaagtctaatatcttataaaatcaagacagttttttatattttcttttaaagtaatgttattttggaaaagaaaattgtgtaaaatttatttaaataatataagagtttttctattttaatagagaaaagctcccagaaatgagctattccagtcatttttcacaatgcttttcaatatgtcactaattctccttcactggaatgaggtttagtgtcattgacattctcatgagacttttctaatataaatccatagacatgatgtttcaatgtcatttaaaatcagctagcaagtctgtggagatgtatgtcaatgatgcaaatgtttccacctgtagatgtggcaatatgacatgatgtctgcacatgacatttggggattcctctcccctctattttctgcagcaaaaatgagaagtcagttctgttcaaacagaaaaaaacaaaaacaaaagcaaaaccaaaatacaacagtgttggtgcttgtctatcatgatagcaatattattccattagtttttactgtgttttggaaattgatattttatgtaccttcatgtcaatgtacttaatagcttttagtaccttaaaggaatactccagatcttacaggacatctacatcaaaggggcagatgctgttcagggagtttaatgtctaaagtggctatcacatttacttgtgctttgtcttatttgcattattatctgttgaaagtatgattaatattcaagatttccatgtttgtcttaggaatcattttaatttggcaatgtctgaatttgctgggaatgtggctcagttgtttcagtgcttgcctaacatttatgaaactctgattttatcttcaacactgagttaaaactgcacaagtttataattccatcacatgatggtagagggtaggaagatcagaagttcaaagaaagtcttggccataggtgagttcaagtctggtctacaatacaagagtaaaagaaaaagcaaatattaggtactgagaaggggttggatatagaaaatggacagttgaaacatagtaaagggatatagagataattgtttgcttattttaagaagttcatggcttttaggggattttggtgatggataagtatagtgggaaattaccagtatggagccaagtagaaatataagtgtatttaacagggaaaagccttacttacagagtgacctagccagccggtgtggcaggagtctgtacagcaagccgaaagggaaaacgaaactgcaagccaaacaggcatggtcaggcagacctgtagccagtccctaagcagatatggctacaggttcccctacaatcccccttttagtctaaaagaggattaaactgaacagtgtaaagtatccaaaattaacaatcataaaggtgaaatataaaagacacaacaatctgcttatgtcacatcctaactatctattttaactaaaccctaaagtcatctgagagaggtgtccaagcctgaacagctccttccaatcccaaccataaacaatagggagctatccctaactaggtatatacactatcctaagtgacaacaatgggggaagggggcgtagcatcctccaagttacttcctgcttaaatgggatgacaatagccttgtggggtcctgtaggaagaaaatgttagtatagtgaaagccttgaatggattgtatccagtccaagttagatggaattcgcttgattgaagatcttgcttgaaatcctcaacttgaagtcagtacccaaaactcatggtgtcagtgagcaggataactccatgccccaaggttcccagacaaagagggaaacctgctgccacagcctgccctgttgggccactgagagacattggagcagcttccatatggtctcgccatcccgacactcttgggcattgtacttctgagatgataaagacagatccagataaagaaaaacctctaaaggtttacactatatttaaaaatatatgtaggcttgtgagagaaaaagtatgaggaggaaatgagtagccggttgtggtggctaccattggtaggatttgctgaaggaagcagaggcaggcagatttccacagagaaaccctgtctctgaaaaaaaaagaaacaaaaggaagtaaaagtagaatagtaaaaaaaaagccacctagagatgaaaaatacacagagaatctggatactaaatgccatactgttgtctttaaattgtttgattgccgaggaaagaattactgctgctaaaatacatttaattataaatgctgctaaattaatccaacttatacattttaaaaatgctttgacttcaaaatttaagtctaaggacaggctacttagaaataaaggttttacttgtatttccacagaaaatcaaaagctgtggattccttccagactaatatggtttgatcaagcaagacctcctgaagctgagatgttacagtcttacagactacaaaaacaaggacttggtcagatttctatgttttatcatgatcccaatggtatgaacatcgcccccaatcagcagaacgcagtttagaaagaacaacgcccatattcccaaatattgtttataaatgtatgttttcctttaaatggggttggttataaaagataatgagcatagtcaattttttttaagaaaaagggggaattggtatagattttcatttattgatacaactttaaggtcaattaggtgatatgtgtatgtctcctcttgtttaggaattgtgtttatacagatcttttaaatgatatacataattaaataaggttatatagtcacctattatagtcagaacttataattaagttagttaggttttctagatatacagagatgtatttgagatggttaggtattcttcaaacttctcaaagacctacagaaatatggcatttaaatagtttagggtttttcttggcggtgtgacactactactcctggcacaccaattacatcagaaaggaggatgggcattgaagaaactcattatggagtttgctttcaacaaggcaagattagccatttgggcaagaaactgctcttgcctgaactgtttgtcgctgtataaactagacatgcaggacccacaagaaagtgactgctgaacttacaaaacaagacagtactgaagggttcctgttgaaatgaagaactgtgctaggcacactgtcgcctataggctgaagatggatgccccaacgttacagaggaactttgggtgactgtccaggtagccagatgtctctgtcaattctagagtttatatattatccttgtgtggtctttgatagagttgaagagagatagttatggttatagttttcttcagttattaaaaaagataagttatcctttttatttagttagaaaagtagagatgatggggaatgtactactgtgtatgtttatcttattgattgttaaattactgtctggccaatgagacagaaagttagatgggactaggagtcaaagaggattctgggaaatgtagtagagaagtggtgttacaggcaggaagtgacatagcaaggagactcatatttaagtgaaggagaaataggaaggatccccttttcccctctgctcctgctccagcagctggcataaagcacacacatggcagtggggctcagagactttggcagaaagatttatcgcataaaagttaacttaatagcaaaagtacaaaatacaattttaggctccacagcttgagaacatctagtctaactgttcattaagttgtaatatctgtatctggttagtggtttgtgtgtgtgtgtgtgtgtgtgtgtgtgtgtgtgtgtgtgtgtgtgtgttgtgtgtgtgtgtgtgtatgtttgcatgtgtgtgttttaatttacaagttcttttcaacaaaattttaattaataaaaaagagaacttgcctttaaaaatctgaatttggcaagcaaatgggtccataaaatttctaaaatgtgattaaaaaacaaagtgggacattaatcaggtatatggaagaaaggagaaaaatgtgatcatttaagatttatttaattcattacatgtatttgagataatgcctgaaggagggtaatcttgttttattgagtagagctattcattataaatagagatatatttgctgccacttatttaagtttcagaacacagataaagcttaaaataaaacataaaattgatgattctaagttatgagctcttcacttcttgcttaggaagaaccaggcatgggactaatttccagaaatggagttatcagaattaccatcaagtgcccaagagatccagtcttggtatactcattaagacaatctaagtttcttatggggaagatgtgtcaaacacacaagcaagtgatcaatccttgtgaacagttttaagcactttcaagattgttatcataatattcttgtgaaaaggcaagggtggggattgtacaatctctcatgatgaatctttctaataatttaaatatcttagagaatttatgcctaaaatgatgttcaatatatctcaactttttcttacctaaggtttgttcagatgtaaagatgaaatcaagttaactttcaaatgttttacttttggtaaattgaatgtatgcacataattcattttcatcacctctttcccccattccctcccctccaattcttcccctatcctcccataacttttgttggcaacttcattctctttctttcactcccatccccccagtcctgagtccatttagtgctatctgtgtatgtctgtgtataagtccatctactggagcaggggaaaattttcagaggccaaacatctctgaagaaaattgatattccctctttgagcgcacaccaattgccaatagagacttcatgggcctcttgtctattggaggtaattgggctggcttgaccttaggtaggtcttgggcatggaaccacagctgttgtaatttcacatgtgcaatggccttttcatgtccagcaaatattgtcatactgcagataaccactatttctgactattaaattccctctcctcatgctatgcaataatctcttagcctgagggaaaacgagtgtggtatggatgtcccatttagagttgaggactccaaggtcatctcttggcatgttgacaagttgtgggtctctgtattactctgtatgcattgcacaaagaaatttctaggatacaattgagtaatgcactaaaatcagaaaatgaggagaattattattcattttagtagacagatagtgtcaggttctcccctagtcattcacttttggggaacacggttgacaatacaagagaaaagttccatctttagattttgttttttaacatttcttaacaattcaattctccacattccaaatagtaactaagtatagctttttaaatcctgctatttaccttctctccattaaaattctattttatgaattggatctcctgaaaaccatggcagactcatttttacttacaatttattgggttctgtgtacatttatttcttggaatattatttcaattgacttgaagaatcctgatttgatatctgaaagatgaagacgatgttgctaaagtcaagtagcaaattccaacaaagttttcaaagtgttgctcattagtaatgggatcttacttctgtgggattcaagaagattcttgttccatccttccatgtacttacagaaaacatacattagtcataaatagtttatttaatataccatccctaatcacaattgcataactactatgtaaactacttacggacaactttattttttctattattcactcagcaaactgtgtctcatacatagtgacatgggaacatcacaatagtaaatcatgcattctctgtgaaatttttgtatttgaataacatgaattcatgcacacaggtaacttcttgtttctagcatatatgtgtacacttatttattttattttattttggttgtttgttattacaagaatttaataaaaaatgttaaaaatctatttggttgacattttgtcttatctcagggtcagctgactattttcttgcaggaaatataatcatgtacatttccagcatgttctgatttatgaaaaagagcttctttaaactaatcattcacaaaaattttagtatgggttaatctttttcttgatttctataaggccaagtcaatatcatgaatccggggtgcagagatgtttagatcaaactttttaatgggaggtgctccaagaatttttgttttatggatggtccaataaagaaatttatttgaaatgggatctcaggttggacttgaatttactatgtagctaatggtgctcttcaataaccaatcccaaggccttaaactccttagtgcttggaacacagtgctgtgatatcaaacacagttcatgtagttttggcgataaaccaaaggactcgtgtatgctagacaagcattgtatcaactgagctacatccacagttatacttatcagaagtataagggttattattgcttgtttgcttcagtatatctgaaatgaactaaaatacacaaatggagggcacacctttgagaaagttcggcttcatttgaagtatgtgactccacttctaatctagacctttgcagtaggaaaatacacatctttgatctggatcttgaggcaagaagacacacctttaatgtgggagataccttctgctggaagtccataaaagaaggaggaagcttctgctctttgcctgcttgctcctgtacatttccagcataacacacccatttcttcactggcattgtagcttgtttctttggtgttccagcatatactgaaaactagccaagacatccagccttgtgtactgagcaactactgcattcttggactttccattcacagccagctattgttggattagctggactgcagatttaagacattccaataaatcccatttataatacacacacatacacacacacacacacacacacacacacacacacnnnnnnnnnnnnnnnnnnnnnnnnnnnnnnnnnnnnnnnnnnnnnnnnagagagagagagagaaagagagagagagagagagagagagagagagagagagagagagagagagagagagagattcggtctataagctctgttcctctagggcagtggtgctcaaccttcctaatgctgcaaccatttaatacagttccttatattgtggggactctaaccataaaattagttttattgctaccttgaaactgtaattttgctactgttgtgaatcaatgtaaacatctgtgttttctggtggacttttgatggttgtgacccacaggttgagaaactctgctctagagaaccctgattaatacaagaagtaaaacatacatgaatggatggcatatgtgagaatcctgctttcaaggaagtgagcaaaattttgtattcatatttgatttacaaaaggccaaagaaatctaagatactatcatataaaataagtctttgtattatatgtttttaagatattattcataaaatattactgaaaccaattgatatatgctccttaagactgctggtatgatttgccaatgaaaattttctatctgttttcctttgattggcatgtcatgcttgaataatttcctgatacctgaaatggagtgagtagtaatagctcaactaacaatcatactaaggttttcatgtttgttgtgattcttttaggcttaacatttggagactcaataaagatgggatttgtggttcttacttattaaataagtctataataacattagcgaaagaactttatgtatacagttattgcatcatggaacagttgctacatttctgttttgaatgatacagctaagaggtgatgagtgattttaccatggcagatcaccagagtggaaaggggaaccatgaggtttaatcattttatttacttttattttttgaaatgtgcttaatagaaatgaataactgacttccttcaatattcaattctatttcccagaatgagagatttgagcattaacataacattctgtgtgtgaattacactgaggctttgtcatcctttacatcacagtgaagggaatggctctgatttattgcaacatttttaaagggcaattctatgcttgtaccagagactaaagcaaagtgaaaaccacatttgtcagaaactcagccttgacatagtttatgattactgactattggctctatttatagggctgcatttaaaaataagctaatctaaaaagatcaaatgtgattgatgtttacccatttcattatttttcagggtttcattttggagctttaagatggttataagatacaagctacgtgaagttatgtgaatattgaagaatatctaatgctttccattttcataatattcacttgaagaaaattatttttctaaatattccccttgggtctgatcagcatccaacataatcacattaattttggaactattggatgaattatgaactccctcttcagccacacaagatgttcaatgattatgggaagctttgaatgaaataggtagtgtgtaagccaattatcaacaatgtgcaatacatttggccctgtgaattttaagaatccaagcacaagatatttatcaactatatggttaaaaaaattgtgtttttgttttgttttatcttttatattgaacttgacagttaatacccattctcagtgaaacttgcattcctggtttcatctagactggctgaccagtgagctccaggagtctgtctatcttcacccatcagtgcttagactacaaacacacacagcgatagccagacttcttgcacagcttatgcagatccaaagtcatgcccacgtgcttttgcagaaagcactctcctgactgaggcatctccagaatgctccaactagtttcttcattccattttgttttggatggtaaatgccctcatgtgttaaaagcttggctcagccttgtgtcactcttggagcttagtagcacttttaatctgtgagaactacaaaaggaacttccttggtttcaatgttgccataaagtgaatagttaggctctgctctgactctttctttactttgcagccttcctgaggtgaacagctttgatcttcctggcactcctctcaagatgggatgctgccactaatcagtgaggagtaaagtgactgactgtgatctgaaacctcagaaattgcacactatgctaatcatccttttaagctcattggttatgtattttgtcatagtgaaactaaactgactgacatatctcatagaaggaagagccatactatctatatttttttaacaaattgaatttaaagtgggtaaagttttaatgtaaacagcaatatgtttgcaaatcttcaagtttgacattctttgccccacaaggtggatatttaagatgtggtcaggattagacagtttagcaagctgctcaaaccttaaacttgtgggtgaggagaccaaagaatccagaagcatgtatcaaagactcctgaggtccactgagttcaaagctcaggataactggatgaaaaagtctgactcactaatctgactgaacttcatgaagcaaactgaatactagatttaggacctcttggaaattttacatccttatttgcaccaacaataaagttcgaatgacatgtgcttcctggttcagtaggtatgcctggaaacacttcaccccaaaaactgattttgtgtttcctgtatgagaattcaagtggcagtcatgagtgcttccagatcttagaacacaaagaggcaaataatgtaaagctgaattagtgaagctcgatccataattgccgcttacaccaggcaaggaaaatattttattgcaactgacctgaataatagagtgtgttggaaaaaatgaagcctgtttggttgagacaccatgcaaaaactgaaatacaaaggggaaaaggcagtttcacagaaaataaaatattcatgttgataagttacataaaacaaaagatggagtgttttctgcagggaaattactttgtttgatgagctccatttatgcatgagggagttttaaatttttgaaaaaccctttggttattttttttcttctttcatttctggtggctttaatttcagacataaacagatgtaaaattttctagctaaaagctttttactctgtttaaagttgaatttatggcattgggggaaaaagatgcttttttaccatgagagtgttaggaaatcaatagttaagacatccagtgcattttgaaaccaccctatgataaatatatcttaatttgctttgttcacttttaatatcattttgattgaggcatatttttgagggatgctgggtgtcatgcctgttaaataataacttgagctttagcagcaatctcatttgaatgaaatctactatataagcaacttgcttgagtggcctgagaaactcaagttaatgtttacatgtttcatttttcagatgggaaatcttttgcttttacctggtggttagtatgggaagcatcttagaactgcatcagaaaatgcagatttgcatttttatatattgctaatcaacttggtattcatagaaagagaaggaacatgtgcccctatctgtaaggacttaagtttcaatggtagaatgtcagaataagaggtacaataaaagggtagattttaccttgtaaacttctttggttgtgtatcatatagtcaggatgcattgtgacatggttaggttacttgtatctgtctcataaggataagaacagaggagtgaatgtttacacacggatactctggtaagctttgccagtgcttgtttacacaaagttgtctgatccattaaggacaggccattatggaaatgtacttagccaaacatctataaacactgttctagagaattaccaagtgtggtaaataagcaactctgcttgtacagaatctgtgaattttctctctacaataaattaagttgtaaacctcctttagtagtgcactggtctcctggataacaaggattcaattaagagacttggcattatgtcatcactgtgtatgttacagtatctagtgactacagcatgttttggaaacttagtcaatgctgaacttataagcctaatataaaccttacattcatctattattttatacatacacaggaataatcttgaccctttattatagaaagacaatttaaaagtgcatagacttatgaaaggataatgcttaagaaatttaaaagatttgggacatctccacttttatgttttgacatagtggttttgctatggttgtgtgtttcataaatattgactgattgtgaatccttagagagccaagaaaaatatggtccatttacactctgggcaagtccacagttatgtgaagtatggagtgaatccaatcaacactttataacttaaaatgacaagtgcacctgttagtacaagttgcggcatgagtctgctctatgggagaaggatgcagttttgagaagatggtatgcagtttgaattctgaaaagtaaatgagtagaaggctaagaagggaaaaactgtttacttttccttgcaagtcatcataatcctatcagaaaacttggaccttaatgatgacagctaagctgctatgcaatcccaatatgtgcagctagctgcagagaaagcagaggttttaagaaaagacctgggttgagcctcagctcttagtgtctctagataatttaatgtatgaattttgtttgttcaacagttaaattggttaaataatctcttacttcctgaatgtgttgtatctatatgttttcaacaaagtacaaagcatgggtttagccaacaagataaaaaaaaaaaaaggcttcgttaatcaacattgaacatagcctatagttcccagtatgggctttctacagaaattacctcaaagcttggtgattgagatgtattattatagtttcaaagcacttatgatattgtctagatattagactgaaggaaaaatatggtaagttgaaacaaacaggccaataaaaggagatagttgtcactggagaaatggcttgttagtaagtgcttgctgtgcaaatttgagaacttgggtttgatactcaaacacatgtaaaattttatggaatgttgatgtgtgcttgtgatcacagtgtgagggagttgaagagtggtaaaatacttgggctttctggccaggcagactaatatcctggtgagttccaggacagtatgagaccaggtctctaaaggaaaagtaaaaacaaaacatatatagctctcaaagaatgacacagttatttgggattgtgccctggtctctatattcctgcactcaactttcacagcacctagtataaatctaaaatataattaatatattttaaaaatgaagttgatttggaaggacagatttttcctgtgttctagagttctctaatgacctgaaggacagcaatgatagctgaaatttttctaactttaaattccttggagtggcatggaaggagcatggaggcagtagctaagaaatctaactctgagttcatagagattttaacagtaccacagtttagtatgtctgactgatgtacatctctgaagagagcaccaatccactttgaagaagtggaatccagcaaaggaagtctaactcagacatctaaccacaagcttggtgactgacaagggtatttctaactgtgatgagttaggagagaagcaagtgaactgtatgacagcagaagaaaatctaaatacatacttgccagaatgatgtttcccacttcatcttaaccaatttacccctttggacctctggactactataaatcaactctgccattctatcgtgtttctctggaaaagcatttcttggccacactatatagtgtgatattgagcatgagagaagcaaagagaagtaaaattgttgtcagtgaataaatatccctataagtaagttaaaagtctcaaggtctgtagttttatttttttatataaggatcaactacacttattgtaagatgagatgaatacataagaatgtgagtgatatcttgaacaatttctaaagtgaattatcctgcccttgcaggataatttttttcttgacatgaaaaaatccatgataattgaaatataattaaatacatttatcccccatgaaagattttaatattgtagaaatatttccctctgaattgtaattgctgaaatagttcccacttaaaattagcattgttgagcttgtcataaggagacatgaagttgcatcactgtcagagaagacttatgaaagatctcttaaacttggtgctggatgaagaaccacctggaaggtggattaaaggtagaattaaagactagattacacatagggtattaggtaatcagcaatgaattttcttctttttcacaaacttctctgaattggaaactcatttgtccatgttgctttcaaattttcagggagcagattccaccatgaccttacatttgtttctgctgttctgtgtcttaatcagctgatcaccatacagcgcttaagcaaccttctactagcacttcctacagttagtcatgttttgtttggctgcttgtttactacattgcaaaaaaaaaaaaactataaaacatgcatgtgttgtgaataactttctggtacagggaaggaagctacatgtatatggacttccatatactacatgtatatggaagatggtgtggtatcttatgaagagaagaaagcatgctcttgttacagaacacatgctaaaagtagacagtgtggaggaaggtccagaaagtagatcagggagtgttttcaagaattagcgttgtttatggctttgtctgtgggcacttgtgtgtgtgtgtgtgtgtgtgtgtgtgtgtgtgtgtgtgtgtgtatgtgtatatgtatatggagtatacatgtgtatggttgtatatatgtgagtttatctaaatatgaatgtgtgtgcatgtatatgtttgtgcagatatgtgtgttatgtgtatgtatgtgtgtgtgtacaaatgacatggttgtgtacacagatacactcattcattcatggacttaaactataccacacgttattcaacttcacagttataaaataagaaaatttgctgaaaaagaaagaagggattgattttatcttgaatttaatacttctacagaagtccacaactggtcaaagtacaagaacaacagggctgcccacagggcgctcaacccagtagataaatctataagatgactctgatactcaaggcttgggaacactgcagaagatggtgtggaaagattttaagagtgagaggctcataacaactgcaaggtaatatcttcttgtatgaaattgtggcttcatccataaaactcacaatgtgctttccaaaccatcaccagcataatgataatgccagctgacatgttggtatagctgggagaaatctcacaaggacccaagcatagatgaagagctacagtcaactaatggctactgagagagaaagaatcagttttctcgagggatgggaccctgataggctatagagtccaaagtgatcagccctaaagacatatacatatgaacaatactaatggactcagaaggttatatccatatgtatgtatatatgcatatttgtttatgtgtgtgtgtgtgtgtgtgtgtgtgtgtgtgtgtgtgcaacgaggatcattaaaggagatatttggagagcaagtgaagtcagatatgggaggcatggatgggtacaaaagggtagtagaaatgatattaatgtagtgttaatatatgaaattctcaaaaaatatgagatgataattagcgtaggggagcagatgagccagtcagtgaagaactgagggagggatgaacatgatcaaagtactgtgtatgaaattctcaaagaactaataataaaagctaattttcttgtcttcgtttgttatttataatgacactaactttcattactactgtaaacaaaacagaatgtactatttatcactctgttgatccaataactactctcaatgtgtagtcatcatatactagataatttggtaaataccattatttatacttttttttaagacagagaaaactttgtaactattttcattggatttttagcaggaacttcaaacccctacaaagcaatacccagaaaatactgtaaatatgttttttctttgtatatgatcttgtgtgttcaacaattgggcaatagctgaatggagttcagtttcatacagaattaacattgtaaaatgttgacaagatgtgtcatcagaaaagcttacaggagactatatccactaaagtgagaggaagaaaagccaggaggcttggttttatgggtaagttacatgatggggaagaaggcaacatgtttggcattaaagagagaacaaaccgaatggcagacagatggagaatgagaatagccagagcaaaaccggacaattgtccagcttttaattcagaataaaagaagatgagagaaattgactttaacagagtctggggaacccatttcagccagaccctaacgtgtttccctggctttgaataataatgatgtgtctgcatagttacatcatgtaaccccatacaaacttcacaggcttgtgggaagcgaggcagctggtgcttctcccatttcacagattgcaaagagaaacctggtcgccaaggtcacgcatccggtaaataacataagggagagcagccgcgttctgacttcaacattttgaacttttcagtttgtggtgcgcatcttgaaacaggaggaggcagaaatcttctgtgagaaggaaagcattctaggcagtcgtccaaaagtggtcccttgccgcccacccactcacttaaactgttgtcacataggtgcgtcccagcaaaccaacatgctgcagatagaactggctgtcacaaaggagcagaggtaccaattggatacttgcttgttttttatattaccatccgtacacattccaccaagtgctgctgatacaaacactaacaaaaacagccattgtcccagtatttagaaagacaactttttactgggagatgggcttttttatcaaaaaacagaagttactttcagtggtggtgtgaggtggtttttaaggaactttaaaaaggtttccctatacctttgagatcaggcagcggtttgcttacctgacataatagtaagtgtgtaaaggggggaaccaaatgtgtgcagtagctgggtcatatgtgtttccatttttcatatttgaagaaatctccaagctgatttctacaatagccatatttaagttttgccccaccaacagcaaataaatgttttctctctacatcctctccaacacttgtcaggtttgttggtggtagccactctaactatgatgaggtactatctaaaagtagttcaaacttgcatttctctttcgatagggatattgaactcccctttttaaaaagtttcatggattttagccacttgtgtttattttctttgaactgtccatttatttcatttgggcatttgttcattggcagttttcatccctcggtatttaattcgtgagattctttataaattatgaatatactccccttgtctgtggtctagctggtaaagattttctccacttctgtgctctgtcttttactctgatgatgcatagagcttctatttacatgtagtcctacctgttgatacttggcatgagttcctgctctgtgggtattctattttaaaagttattccctaacccagtatcttgaagggtatttatttgtcatattttctaaaagtttcagtgtttcaggttttaaatagaagactttgatccattttaaattgataaaactagattattccatgctttatcacagagatatttccatccctgtgtttatcattgctgtattcagtatagcaaagaattggaatcaacatagtttgtctatcaatagatgaatgggtaatataaacttggtacacatgcacacaagcgagcacatgcatatataatagaatactactcagctctaaataaaagtaaagttataattttaaaagttcgtaggaaaattgataatttcattatataatattaagatcatactgtctcagaagcaagtaaacttgcatgttctctctcatatgagaaatgtagccaatggtataagtctgtaagtaagcaaatggagtaaaacctgggcaatagggaagaagaaaacctaaatataaagagatggtgaaacagaatgcaggtaatggacacaagttatgaaaacagatgtaaagctaattgtttccatagttctaattttgtcatggtttttgttttggggttgtgaataagtgcataaaatatattttatactgaaagtttaaattttaatgtgaagtttcacagattctgtttcaaatgtcaattctagatttatataaatttatcaagttagatggaatttatttttaaaaataaagcttataaattttcaaaataaagaaattaaataaaccaggggttgctccaagtagattcacatatgtgacgagatgagaaaattcaacatgattagagtttccgtcttaagcaacatagaatttttctgtacatgttgttgatggtaagactgaggcatctcatttcgattcagtatttttactccaaaggataactcttgaaagacaaattacaataatttgttaagtgatcttattagcttggttgagagtcacacatcagggaatgtctctcaggaagatggagagtgtgatactaaatgaggcagagttgttttttttttttcaagtgggaataagtgattaagatgacagataatagcagataagttaatatcagatcattacaggtcaattctcttataatagtttaaacaaaggggacatcattattctgccactgcagacagataggacccttcccaagaatttgtgctactcttttgttttcagggaaacaaaaaaataaacaaaaaaaacaaacaaacaaattctattgggagggatttctctgcttccttaaattttcattttggctacatggtcctgagcacaaaggaaactgttaagttttctgctgtttaggtctggtctgaaacagtggcttccaacacatgtatttatatggtatagatttctgatccttttgaaaacattggcctcagccccagcaggctgcaacctagaaatactgcactgatgaactgctgtctttctctgttgtctagtatggcagccataaaccacatgtgaccattgaacacttaaaactttaaaattttctttaattttaattttaaaagctacatattgttagtaccaaatgtacagctccacacaaggggaaaacaggaaaactacaataagtttgacacatttgacataaactttatatatcttgtgttttgtggcctgaatgtaattgaaaaatgtgttttcttggtataagggagaacttaccttgaacaaaaatttaggagtgaacaatagctcattttccaaactcactagggaaataaaagctcaacatgtttatatcaaaaaaaaaatctggctaaacatctaaatagaaatccatagaaagttatttttttagaaccccagagttaatataaacaacttgccttgtattttttacttaagtaaagctacctgtaaaaagacagaaatcacaaaacaaatgaataaaactaattatgtaacaaaacatcaggaaatcctaatggctaattcataaaatgaaatgggaaaatgatctgaggtcagccaaggcatttcccgccattatatctgatatgttaggtttctataaaacttcatttctctctaaaaatatttgtattggatatgagtggatactgtaaatatggaaaatgaaaactttataaaatatacataacaaaaagtacatttgtggtgatatgttgtttatgtactaataaagccactggggatcaaaatgcaaagttagccacagccatagagccaggcagtggtgatacacacctttaatcccaggactcaggagacaggcagatggatatttgagagttcaaggccacccaggactacacatgactgaatcagctagaaagaataacagagctcacacctttaatcccagcagtagggagatataaaagaaagaagttaagggtctcatctgagattttgtttccagacagggagaacattgtgctctgacgattcggggagacaggatcacccatttcagtctgaggcagaggtaagagatagtgactggctgctttgcttctctgattctgaacttggaaaccaatatctgtctctgggctttattatttgtaactaagtggataaaaacacttgctgacttgtggctagacatagtgaactgacttgaattctattccggggacctagatggtagaaggaggaccagcttctacaaattatagtttgaactctccatgatccttgtggcacagacacaactgcattattacacgtgtacacacacacacacacacaaacacacacacacacacacacacacacacacacacacacacacacacacacacacacacacacaactacattctcatgtacacatacactaaagtacataacatgcacatgaccacaatctcatgcacacacatacacacaggaccacattttcacacagaagcatgcacatacacatacaagcaatacataaataaatatataaatgggggaaaagtacattttgcatcatggttatatatagctacctactaacattactcagtgatactaataattttagttgctaaattttagaactattttacttactcctcaatggacaatttatttattatatgttagatggtattctaaatactgggttgatatatagaaataagcataccatatgacattgattccttgaggaaaatgaatgatggatgaatgaatgttgtctgaagcacagagctgatgtgagtgaatggatggtattaaactgcggcaactgaacaaatttaaaagcaggaattctgacagagctgaacttgctaaaacgaaaaagggaaatgggattgagtgccttattagggaaggaggttacagcttaaatatgaagctcaccaaaaacttaaaagaactttttctgtagtaaagacttgaaagaataattgagcaatacatgctattcaaaggcctaaacacagatgctggtctagcttctcccaggctgacattgttgaaatgtcttaattaattaataatgccatttactgaataataatagttatgttctgtatatggtattttttaatcactacatattttgagtctgtctgttaaatggatagaatcagaaaaacaataattctgagtgaggcaacccaaacccagaaagacaaacatgttatgtacttaatttagagtggatatctattaataaataggatattcatggtacaatctacagacccagagaggctaagaacaaagatgtctctagggaatatccctggaaatggaatacagaatagattttgagagtggacttgggttgttgcggataagaacaggagtgatcaggtggaagagggagggttggagcgagagagtatagggagagacaattaaaattggggggcactgggggtcaacatggaaaaccagtgcagtggaaaattcctggaacatatgagggtaaccctagccaggattcctagcaatggaggataaggagcttgaaatggtcttccgttaaacaggcaaggctttcagttgtgggcttgagacaccaaaccatccacaatacttgatctaccatgtgtcctgcctgcaagacttgctggtgaagctgtggctcagaacttgtgggactggctaatgaatggctagtctaacttgaggcccaaacctagagaggaagcccatgcctgacactgcctggttggccaggaactgaaagctggatagccaggagaactagggtagaactaaacacaactgacaacaacagcaacaaaaatgtgagtgaaaagattcctagttcctaatgatattctgctatactcatagatctgtgtctagcacaatcatcatcagataggctgcctccggtagctgagggagcagatgtagagaccaaattcatgtgagtcaagccttaggtgaagctcagggaaccgtacaggggagaggactgtaagagccagaggggttgaggacaccaggaaaacatgccccatagaatcaactaagcagggctcgtggagcctccatgggtctgtgccaggtcctctgcatacatgctgtggttgtttagcttggggtctttgtgggactcctaacagtgggaatgggggtgtctctgactcttttgtttactgttgggacactttatctcttactgggttgcctcttccagccttgatatgagggtttgtgtctgtctactacattttgttcctttgggttcagttgatatgtctggaagccttccttggtcttttctgaaaggaaatggaggagcagtgggtatgagggagaggggaggtgtgtgtgtgtgtgtgtgtgtgtgtgtgtgtgtgtgtgtgtgtgtgtgtgtgtgtgtaactgtggggagtggagagaggagaaactgcctttggcatgtacagtgtgaaaggagaataaataaaaaaaagagttttgtgtagtgttcattcactctactattagcaccatactcagtgatttcacagaaagtgattgcatgttaaattctcattgtttctcttatggaatgtattgtgcaacatttggcttcttcattgttcttaaaagctgagttaattatgaaatacaagcacctgcttcttagttggaaataggaaacagattgttctgtattcgatcaatatagcctgacataatggctagattaatttgtcatcttgacacaatataaaataacctagaaaatgagtctgcatgagaagtgatctagattaggttgtctatggacatatctgggaaaggattattttgatcatgctaagtgaggtagaaagacctgcccactctgagtggcactatttcccaggcatggaatcccattatgtgagagtagaggccgcaagctcatccctaccaagtatgaacacatggtttgttctctgcttctgatcatgcttgtgatatgagcaacttcctaaagcttcatttgctgtgacttccctgctgtgatgcagtgaaacttggaattgggacctgaagtaattcattttgttcctgcagcattctctgtggatatttgtcacagttacaggaaataaaactaagataccctataaagaattgctaagatggtgtattatcataatcacaacatcattacatacaaaaggcttgtaaaaggtcatgacactgatttggtgtattaatgggtacatcaaagtctagagagaagtaaaatgatgtgcacacactgatataatggatggcattcgttaccattattgttgttctgtacttcgtatttggtagctaccaggtgtagcacttcctacagcatcatgtgacagccatcattgtttaccaattacacctaactgctgagaaacctgaggaaaagaagcttcttcaaagtcacttggctggtgaacagtgtagctgaagttccatatagacaagattttatttatctcaggaagagataattgttcaggactagatagagaggttttccctttgaacagtaaagagaaaatgtcacttctgcctaatacctaacttgacaggtatgctatatgttttgtaagaaatattttctcttgaaaatgaaaatcgttattctgtttaacttaagtagtaacatgatgcaatttattgggagtaaatcagacaagccattaaaattttcacattcagtccatgaaatcattctcctagggtacataaatcatgttcatttgtgaataaaaacattctctgtctaaaacagaggataggtcataagattaaaaaaatagaacttgtaatttgaattggtattgcaatacaataccaatagaattttgaatgtttccactgagtaaataaaaattaatgatgttcattagttcatcccacactatccacttaatttatgtatatttcatttatatttatatatatttgaaatctgacttgtattcaagcaagaaaggccatattcttatcaagaactataatgtttcctttctctaggaaatgtacatttgaaagaaaattattttgttgacacaagtacatgtgtagtcccaagtcaggtccataacagtcatttaatatttactagatatactttcatagttttcaaatccaaaacagagttatttagcagttctgctaataagctattactctgaatgcattactgatttccattgagggtcctatggtctagttaccttgattgctgtgttttgataaatatctttttaatctcaagttgtccttttgtacatgaaactgatctgatttaaccacagtgggaaggacattgtcttagttatttttacattatttgtaatgagtttacataaagcacccaaccttacacacagaccccctaggctgataacttaaggcatatgctagatcaccaactgagatgacagtgtataatctgtggctagggatcagagatttctctgtgtaaatttaatttactctagtggggatcaaaagctcattaatactctactttttccaactgagctataagcctaaagcaattagtattcaaaaatattttctttcattaacatttttgactatgtaacctgttttgtttccatgttaggaaccaatatgatgctttaaattaaaaatgcatggggatttctgttgttttgtgtcactattctcaaataaatatttatatacaaattaagcaacagcaaaaaaaataacaaacaacaacaacaaaaaacagagtttagatgcccatttcttttttactttccaaataaagtgactaataacttccaagggatcaggattattcttgcacaaaagaagaagtgagaaaacatttttaatcattaacacaagagagtttgccactttgcagcagggaaagacactgagtactagctgtgtgagcctgcaggctgttgatgagccacacagatgtgtgagaaacaatcttccagcaatgtttaaaatggatagtgaatgaataaacatttttatgtgcttcatccagaactatcctatcatcagttattatatgcaagtctgcatgataacacagtttcttttaaatcctaccaaggttttcaaagaaactgttcaagaacagaaaaagatgataaatcatgtctaaagcaatttggtcttgttttgcttttgaacactgacataatttgaaagtatgatacattaccaactatctttgttataatagcatagtgacagataatactgcaaatggataatctgtggtactacaaaccatagattagcaaagtcctctataataaacaagaatccattttgtcataattccctatggcacagcatggggctgttcatggggcacaataactttttctgtcttttcttttccagttcttgggattttagagaagggggacctcctgtagtagttcagtccttatccctagcatagttgtggacttcaggggcccaatccacatacagggttactccctgagccaagacacacatgggtgggcctaggccctatcccaaaagacatgactcctttttataggagccaaagtaaaactttactttcattaactttgaaaggaaattcagatcctttcattgttaatatatttcatctgtgtcttccacaagtgacaactgaaaggttcaggcattatgctggcctgcccctgatacctggaggaacaggcagtaccctggtcagcccagggttccatgggaactaagtctgcatgcaggtccagaggacccctttaaaagacagatccctgcccatttacgttctctctacactcactctctacacttctctctctacactctctactctcctcctcttttctgtctgcttctcctctctctctctctctctctctctctctctctctctctctctctctctctctctcttctctgactggctgggtgactttcctctctctctctcgaccggtcatggtggtcagccattaacccggtttgtcctctcctttggtctccctactcttctgggcctataataaactgtctaatatgtctcatcctgtgtcttatcttgcgccccttcttctttatttttaatttagacaaaagaataacaacaactttgaaatcaatatatagaactcactttaaaatggcattattgtttcagtaggtatctaaagttacttgtgtattatcagcacttgaagataaacagacttcacaatagtatcgttttaacagaaggtttatttacccacatgtgaatgttttcaatgaaggcatttagcctatttaaagttttctgtgacaaaaacaaaaatgtcaatccacaggaaataatttttgctatttttttatttaaattagaaacaagattgttttacacatcaatccatttcccactctctcccctcctcccctactaccaaccccaccaactacaaccctacctatcacatatcctttctgctccccagggagggtgaggccttccacagggtgtcatcagagtctatcatgtcttttgggatagggcctaggcccacccatgtgtgtcttggctcagggagtaaccctgtatgtggattgggcccctgaagtccacacctatgctaggaataaggactgaactactacaggagatcctgtagatttccaaggtctcctcattgaaacccacattcctggggtatggatcagacccatactggtatcccagcaatcagtctggggaccaagagctcccattgttcaggtcagctctttctgtgtgattcaccagcctggtctgtattttaagtataatttgaatctgttatttgcaaatctttccattattggtcttcttaaccttctctttaaaataatgtgaagtaaatttatgaaataatgaatgaaatttataagcaaaagtagaaatactttgtgccaactgaccagaaggaatacatttcagtcttctaccacttatttttttctccttctttattttttccattcatttatttagctcataaataaagtcatacacaattatgatgcacaatacagtatgttctcaatggcatggctaaattaaaccaattaacatgttatatcacatatattcatcatttttgttttgagaacacttaaagaatactatctcacaacttttaaaatatagcatattgttatcaaccatacatatcatgctaccagtagaccttaagacttcacagagtccattcctcttgtccaactgcagttttatatccttaaaccaatcatttccccattgttaaaagacccacattgaagcctaatagccacaattctgctctctgttcccataagttcatcatttctaggttacacacaaaattgaaattgtgtgacatttgtcttccagtgtcaagcacacatttttaaattctttttacctaccttgaaaacaaaatgctacactagatgagttagagagttagctgaggcagcagtcttgctttgcatgtgcaggaacaaaggtatgatccccagcaccacaaaacaaaacaaaacaacaacaaaaaaaaccaacaaaatgccactatattacagagaggacatgatccaatgcttcaattatatgcttagatttttatactgaacactgtcaggatttcattcagatttaaaaataataaaattttatatgcaaaagaaaaataataccttatttgaaatgtcacagtacatttcaaaatgtactgtgaattaaagccacagaattttaaggcaggagtgtggagcatgcctgcattagggaagttgaagaaacggatcctggggctacataagatcctgtttcaggggctggagagatggctcaggggttaagaacactgactgttcttccagaggttctgagctccagctgataggtatttctcatcctgctctctttcctctattcttctcccaactcaatgtttctgcccctccatttcctctcctctctcctcttctcttgctcttattgtagcagctccttccccagctaacctcatgcccccaattagtttgggagttcatgccacttccattgctggggaccatttatcccttaaagtccttcatgtttcctagtttctttggtgaagagcattatagactggtaatcctttgttctaggtctaaaattcatatatcagtgagtacataccatgcttgtctttttgtgactgggttacctcactcaggatggtttcctctagttccatccatttgcctgggaatttcaagattccattgcttttttctgctgagtaatactctactccattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttattttagccattctgacaggcatgaggtggtatctcagagttgttttgagttgcatttctctgatggccaatgattttgagcactttcttaagtgtctttcagccattttagattcctctgttgagaattctctatttagttctccaccccacttttaaattcattgtttgttgttttggtggctagcttcttgagctccttatatattttggaaatcagtcctctgtcagatgtgggataggtgaagaacttttcccattctgtgggtggtcgttttgtcctactgactgtttcctttgccttgcagaagcttctcagtttcaggaggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgctctctctctgccttttggttagtttggttacaggtttgtctatcttgtgtatcttctcaaagaaccaactctttgtttcattgattctttgtactgttttcctagtttctactttgttgatttcagctctcaggttgattatttcctggcgtctgcgcctccttggtgtgtttgcttctttttgctctaaagctttcagttgttctgtcaattctctaatgtgactttcctccagtttcttcatacgagcacttagtgctatgaacttccctcttagcactgctttcagggtgtcccataagttcgggtatgttgtgtctacattctcattaaattctaggaagtctttaatttcttttttatttcttcctcaacccaggaatggtgcaattgggtgttattcattttccacgcaaatgtaggttttctgcaatttgtattgctgttgaattctagctttaatgcatggtggtctgataagatacagggggttatttcaatacttttttaactgttgaggtttgctttgcttccaactatgtggtcaatttttgagaaggttccatgtggcgctgagaagaaggtatatacttttgtgtttggatggaatgttctatacatatctgttaaacccagttgtgtcataacttctgtcagatcctttgtttttttgttaagtttctgtctggtggttctgtttaatggtgtaagtgggtttgaagtctcctactataagtgtgtgtggttttatgtgtggtttgagctttagtaatgtttcttttacaaatgtggttgctttcgtattaggggcatagatgttcaggattgagacttcatcttgatggacttttcctgtgatgagtatgaaatgcccttctttatctcttttgattgctttcagtttaaagtctaatttgttagatattaggattgctaccccagcttgtttcttgagcccatttgattggaaaattttttcgcatccttttactctgaggtatcacctgtctttgaagttgaggtgtgtttcttttaaacagcagaaggatggattctgtctttgtattcattctgttagcctgtatctttttatgggtcagcaccatttgttgaagatgctgtcttttttccattgtatagatttagcacctttgtcaaaaataaggtatccataggtgcgtgggtcgatatcagggttttcaattcgattccatttttttgtgtttggtgaaattcgattaactactgacagtgtttttgtgagtgtagttatgttcgttgggttggagttttccttccagagccttctgtagtgctggattcgtggatatgtattgtttttaatctgtttttgtcgtgggatatcttgttttctccatctatagtgtttgaaagtttttctgggtacagtagtctggattgacatccatgctcccttagtgcttgtagggtatctatccaagaccttctggctttcagagtttccattgagaagtcgggtgtgattctgattgagacttttgcctttatatgttagttggcctttttcctttgctgctcttaatattttctctttattctgtagatttggtgttttgattattatgtgtcaggggacttctttttgtggtccagtctgtttggtgtcctgtaagcttcttgtactttcataggcatatccttctgtaggttggggaagttttcttctatgattttgttgaatatgttttctgtacctttgagcagtatttcttcaccttcttctacacctattattcttaggtttggcctttttacggtgtcccatatttcctggatattttgtgttagggttttgttggacttgaggttctctttggtggatgaatgtatatcctctagcgagtcttcagtggctgagattctctcttccatctcttgaatcctgttggatacacttacatctttagttcctgatcgtttatccaacctttccatttccaacatggtggtagactcattttcttgaggagttgccataccagtggaggagtgttcctctttctccgcatcctctctagcataaactgtcattggtatttttgattttagccattctgacaggtgtaagatggtgtctcagagttgttttgatttgcatttccctgatgactaaggatgttgaacactttctcatgtgtctttcaatcattttagattcctctattgagaattgtctatttatttctgtaccccactttttaattgggttgtttggtgtttggtgttcttgtgttctttgtatattatggagatcacccctatgtcagatgtggggttagtgaaaatcttttcccagtctgtcgactgcctttttgtcttgctgactgtctcctttgccttacagaagcttctcagtttcaggtggtcccatttatcaattgttgacctcagtgtctgtgctactggtgtaatgttcaggaagctgtttcctgtaccgattaattcaaaggtatttcccactttgtcttctaataggttcagtgtagctggatttatgttgagatcattgattcattttgacttaagttttgtggaaggcaataggcttgggtctaactgcagtcttccacatgtctgcaaccagttatgctagcaccatttgttgaagatgttttctttgttccatcatataaatttggatagtttgtcaaaaatcatgttttcataggtgtatggggtaatatcacggttttcaattctattccattggtctaccagtctatttttgtaccaataccaagatgttttcaggactatagttctgtaatagagcttgaagtcagggaggggagaggaggacatgagggtgcaggaagattgagctaaggaaagaatagaagagataccatagtagagggagccattataggtttaaagaaaaacccactaggcactcgggaaatatccagagatatacaaggatgaccccaactaagaatctaagcaacagtagaaaggctacattaaatgtccttcccctataatgagtggtagagaatcgaccccgctgggatcctgtctctgctgagattgctgggccattctggcccccacagagtgtggagtgtccagaggtgactgattcggcccctaacttgggcccaacttctgcctgcctgccctggcaaatcctaccccgggatctgcaggcagacagaatcagtccctgaggaccctgggatcctgtctctgctgagattgatgactaccttatattccatcctagagccttcatccagtagcttatggaagcagaaacagacagccacagctaaacactgagctgaactcctggaatacagttgcagagacggaggagtaatgaggaaaggggtcaagactagcctggcgaaacccacagaaacagctgacctgaacaagagggagctcatggaccccagactgatagctgggaagccagtataggactgacccagacccccatggacttatcttagactcagtaattatcattgcaaatgtgcctgatgctgatgttattgctcagattcccagatcacaggtattgtgatgtacaatatgctaaaactaagtcttttcttttggtagcattgaaaactgacttggacttaatttccatactatgggaaaataagtgacccacagtgcttccctctggaaacattaaatccataataatatttgtgtttgttcctaaattcccaatagacctcaagcttcatcccacattttaaaagcataattttaacattaggttagaaagctaaaattctgaatgagacatggttagatgacactataaaaatataggtgagagtttatctatatgattgcatggggatgaagtcatagacatcctcttgagatattttgtgtccaggatcaactatctttaaccagatttttgaagattactctgaaatctatagctgtgtgcagtggataattctaactagattgaaaaatgaatgtacatgaagtatgtagttttcaatgcatttagtttttggttccttctagatttatgtgtgagtattggtgtattaaatgaaatattataatgtcaaaaacaatatagaattggaagatgaaggaaacaactgcttttggtgtctttgagaacactgaccaaataagacagtctgagaagacagctaaagggttagaaaggagaaaaacaaaaacaacagcacacactctacaaaaaaataaaaataactggtgctgttgagcctcaaaaagaattctagagagataattcatgtttacatatcatctagggaaagtataaatgatggataactaaaaacagtgctgacatttttagctggcacacgaattcctaaatctgtagatgttttcatacaatatttaagtaactgacataaaacaaaacaaaacatggccttgatggcaacatgtgtgagcaaatgtatggaagttcccgttggtctctaaattgtggagtctcccaggaaaggacatttatggaggaacgtgctgctatactttagttcctgacatccatttactcactgtggtcaaggttcctaattattagcattgtacaagctggactaaatgttgtatgctatagtgtatttttcctagataggcattttattggttgggaagacatgaatggaacctcagtataaagtggtgacagaagttaatcttcgtactgcaaaaaattttgtgaaaatctaagcttcctgctcagccttactttatgggaagatggtacactgagattggggaaaaaggctattatcatcaaggctattatcatctggtggcattgagggtttatacctatgatataatttggaaaatattgtgaataattgacagatcaactgtgatatcaaatgaaccagttaataaacaggatggtcaagaacttcttatgtaactttgggacaaaactttataatttattaacagtggtatttttccatttgtgactggtactcgtgtttgagtcatttgaagtttatgcaacatagtaaaaataaagtgattaacacagtgtctcaatgacaaaagatatttaataaaaagcagcttttaaattattacacaattacataatatgtatgcaattatgcaacagaattagaattcctattgagttctagaaatatagatcacactaaaatttactaagatttttgtttttattttaattctatacctaacatacttgatttgctgaagaacaaatacatagaaaggttgtgatgataaggtatccagtcttggttctattttgtttacactgttatattctgatatgtcacattacttaatgccagtttggggaaaggttatggcaaatgataagtatactgatggttttgatccatattgtctctagagggctatagaaaactgagctttctctgagtgttagaaaatctttgaaaggcactgtcatcattctatctctgaataaacccccgaattgggccagatcagttcaaattaaaatctattgatgaaacagttcagtatgttttcctattatcagagaaaaaggagcttcagagcattagagattactcagagtgtaaagatgcttgttattcacacctggtgacatgagctctaaccccagacctctcaggaagacaaaggaagagaaatgactttactgagtgtcctctaacttccacatgtatataaaggtaaacaccaacacacacattcacaagcacacacaagtgagtgaacatgcaggactactatgatgatgatgataattttttttaaaaaagcaaggaattggaaagtctcttattttgcataaggacattcatataattaagtggtaaaatcatatgtatcattccaattaatcagttaaatgtatgttatttttcacccatgcataaattaattaacagaaaatcagaatagctgaaaaacttactcaaataataaatttacaaatagatactgatttcttcctagtacaatatttcaagcataatacaataaaaatcagaaagcagaataatgtaacataatcatatactcatattatctatgttatatacagaaaacattgttagttataactttgaatacagaaaaatgccgaccaaagatatgtggttattaagggaaaagtgataacacacacacacacacacacacacacacacacacacacacacacacacagacacacacagacacacacacacacatctcccttcttagtcttttaggatctactttaaaaagaattatgactataggaatcaagatatttttaggattttcacagaaaatgtcaagtgtcaacaaatccttagaacctagaaagggcaaaatgcactcttaaatacaaattcatcataattctggaactgacaacattgtactcttagttttgaacattataaactaatgactagtttatacacacattatatatttagtggtttgtgtttcttaacacaaatttaattctgtcactaactccaatgtgataactttgcaagtttgtattagtaccacctgttcctcctcctttcttgatttatttttgaatattttcttaattctttgataattccacacaattaatataaaatatattccctctccctaacctctcctctcaccaccttctcaattcttccacccattcccacccaactttgaggtttcttcaacctccttctctccctgactcttcctccctcttccccacctcctacgcttccttctttttcatctagtccagttggtgctgcccccttagtcttgggagtgggggctaccctggtgtgtgtcaatccaccagggttcacataattaatgaaagctaactatccctctcctagaagctctcaggtattcatttagtggtaggatcacatgtcctttcctattctgtgctgggattttgtctggagcttgcttagtcttttccttgctgtcacagccactatgagttcatatgcacatcagctctgctgtgtctggaaaataccttttgttgaagtcatccatgatctttacttcttgcattctttccatcccctcttttctaaaggtccctgagtcttggagcaaggtatgaatgtctgatttatgtctggccactccacactcttttgtgcatgttgaccagttgggagtatctgtgttgattgccatttactacaagaagaagcttttgtgtcaataataattatattctaatacctagagaatacagtatcaaaataaaatattgttattaaatattataaaaataaaatattttgagatgtaaaggtggtaaaatttaaggtgttactctcacttaaacttgctgaatgttagctatgtgaaacctttaaaactgaaaccccattagggacaatgtagatcattacaagaaaccagtcaaatcactttaatattcagtggttaatataaaaagacttaacattacctaaatgcacttctttattgaggagagggatggccatttcccattatttcttagtagtagtctttaaaaactctctactcacaagttgaattcttttaaagccaagggggagaaagtcctaatggaaaagtaagatcccacgatgtagcctgaaaccatgtaacactgttgctcaaatgggaaaagaggaagaaagaaaatgtgatgaacccttaatactctaagctcctctaactgagatgtggtggtaattgctttttatttttcgtgccatctcctggaaatggtaatgctttcaagtgaggatcaaagagaatgacctacatacaaaatagataggactatgtagttacatttttcatcctttgtaatatgctttctgcaaccatacttctaacaagaaacacagcataatgctagtcattttttaaaatgagctgtcactaaggtcagatgggatacttggaaactagaaaaaaagagatgattttgtccaaggtgttaatgccaaaagatgaaacagtctgcacataccacccttatgtacttaaaggaaataaaattcaagattcagaaatacatactcagaatagattcattatctctctccaatggggtatatgaatgtgctctctcttcctgtgtgtgtgtgtgggagcggtgttaggagggaagaaaatattaaatcacctattgtttttagcccttaagattctttcgaaacaaatgttttaatataaggaaaacaggatgacatcgttttatagattatattcacattttatacacaaatgaagttttgtttttccattttaaaactgcccaataagatccttatatattaaccacataattcactgtgaatatttcacaaggaaatgtatctcttgtcaagcaatcagagagggtctggtacctaataatgtaaattttcccaaaggaataatccattaagatattattggttcacctgaggcattagatatttacactgatgaaaactgcagaaatatgagagttcttggaagtaccctaacaaggaactggcagagaacaaattcaatggcaacatggaaaatgcagatgactcatttgtatattctccccaaggctacccatttgcgattttctctcccttaacaggttaaaaatgaaactgatgctctaatgatacttatcaagtaatagtggtgatactttggggccatccatttgataacagagagtgaaataaattctgttcaatgactacccaggaaaggtaagtacattggaatgtatcccactggtatagattaaaaattacttctcttccataaagatatccaaagtgacattttattgtcataacagtcgccttcttttaaaaggaaaaattagttttggcatagagttatctgtgaagtcagtcctttcagagaggagcaagggaactgacgacattggccaacatgttctagcaactttggtgtatctgcaaagcactttaaggatgtagaacaaatagaattggattaggcaatatgtttgcaatagtacatatctctataaaaatatagctacattttgttttagatagcagatttgcatgttttgtgcggagcctgacatgttattcttattgtttcttatttttcctataatcatgataaaacttaatatgtattcccagtagaaagagcgctatttctacattatctctcttgagataacagaccacttaaacaatttaataaaatggctgtctgaggagaaaacagagttcatataaaatacttttacctaaaatactggtacaaaaatgcttttatttggaactggtgtcatgttgcttggctaccttgcagaagaaaaattcctcaaagagatactaatattcactgaagtatctttacagtattctgctgattccagctctgcttgaatgtgaactcactgatacttacatagatgagaaaacaactccaaatcaaactcagagatgaaaatgtaacatttaaccaaactgaacgttcaaaccagtatgaaaatatgcttctcatttacaaaattacattctgtaaaacctgaaaatcctgcactcagaggacacatagcaaaaagttccttaaattattaaacctactccaccacacaatctaagcaacagaggagaggctaccttaaatgccctcccctcataatgagattgatgactgacttatannnnnnnnnnnnnnnnnnnnnnnnnnnnnnnnnnnnnnnnnnnnnnnnnnnnnnnnnnnnnnnnnnnnnnnnnnnnnnnnnagaaggacaagtgaagagcaaaggggtccataccaggttggtgaaacctacagaaacagctgacctgaacatcggggaactcttgctccccagactgatagctgggataccagcatgggactgatccagaccccaggatcatgggtttctgtgaggaaacctcggacatctacaggacctcctgtagaatttcattacttatccctagcataggtgtggactttcggagcccattccatgtagaggaatactccctaagccaagacacacagagggtgggcctagactctatcccaaaggatacaatagactctgatgacaccctatggaaggcctcacgatccagggggagcagaaaggatatgtgatagataggggttttgttggggggatggtaggggaggactggagggagaagtgaactggaattgtcatgtaaaacaatcctgtttctaattcaaataaagaaaatgttgaaaaattattaaacatgaaaaataataacagtaagaaatattgccagaacatcagcaaaattaaatatatttggtaaacatgaattaaccattcaataaattaatatttgtgaatttataaagtgaaccttcgaaagaattactacctgtgatgcatgccatgccttcacactcatttgagttattaactctgagacaagttatattttatataccggtgacaagcaaaactgagggagtagggtttcaaagtatggcttcaaatgtatcgtttgtattttaatttgaagattcttttcttaaaagagtctttgaaatgacaacgtaattaaaaattttaattgaaataagtgtacagatttcccttttttgtttttgatgctttctgacattgttgcaatacgtggcatttttcttttaatgaacagtgtgtgccaagaaaatagcactatgctcctaactcagatactacactcttagctcaagaataagaacctataatttctatgagaaaacatagaaaaagaaattcccacaaattaactagatctaaccagcaagaactacagtgaggccataagtttgccttacagattcagaattttggaaataagcttttgattatatttttttaaaagaaaaaagacaagaacttttattcttaccagaaaaacaaagcaacaacaacaacaaaaacccaaacaaaccaaacaaaaatcaaatgaactacaaaatgaaaggaaaaattctacagggaagaatcacacatgaaataatataatctagaatgaaaattcaatgttataaatttgtagcaaattttggattaggaacagtttcttatttacaaaatacttttttcgtttctatcatgaaatcaagataatataacttacatatttaatactttaccttaggcatatcaaatatagagaaacaataaagtttacaaatcaatatggctcttaatttttgtacaatgccagctcaacatggtaaattgtgatggttttttacaaagttgacagcagaaccaaaattttcccaaatttaaattatttttgtttctctgtgtatatttaacgtttataaaaacaaaaacaaaaacaaaaacaaaacaaaagttgtgtgttctgcattaatagtaacaaaagttttgtcaggtactatagtcatcagaatgaaattgtagacatatccctcatattccactaggaaaaaaaaaaggaaaaatcaaatcctgcagagctcctgctttgcttttgatcatatttaaagagatagttgtaagaaaagggagccttagtggcttgcttcttccttttcttctttttctccttcagattcttctttacatcaccagtattttttatatgcatgggtgtaactcatacaccattgaggtcatctagtggatgaacaggcagattgggtgaagtctgtgtgttgagctggttatcccagcatgctcttacatgcctcccagttctgaacagtattagccctgcatttacttgttctacattctgtccactagaaaatgttcatttttcaattaaacagaaatttcttaatgaattgctctaagttgtgagaatattatttgtaagtcattgatgtaatttagataaaggatgtagacaatagattattgggctaactgttatattcataattcaaagtactcttttggttatttgatgattataatacaagactaaaacagcttatgtattatttgtcttctatcttaggcatgcaaacacctctaaaggaagatatttcctttttttttttttttttttgattttcgagacagggtttctctgtggctttggaggctgtcctggaactagctcttgtagactaggctgggcccgaactcacagagatccacctgcctctgcctcctgagtgctgggattaaaggaagatatttccatacaactacagtatacctgtgttgtactagatatgcagaggtatcaagttcacattttagagcattcgcttgctgaatccagcagtaactgctcatgggtctcttttatttttttcttttttttaaatttaaattagaaacaagtttgttttacatgtcaatctcagttccctctccctctcctcctcccatgccccccagctatccccaattccatcccctttctgctccccagggagagagaagccttccatggggatcttcaaagtctgtcacatcatttggagcaaggcctagcccctctcacttgtgtctaggcagagacagtatctgttcctctaagtggaatgggctccctaagtccattagtatgctagggataaatactgatctactattagaggccccatagattgtccaggcctattaactcacacccatgttcaggaggtctggatcagtcctatgctggtttcctagctatcagtctggggtccatgagcaaccccttgttcaggtcagctgtttctgtgggtttctccagcatggtctcagcctctttgctcatcactcctacctctctgcaactgtattccaggagttcagctcagtgtttagctgtgggtgtctacttctgcttccattagctacaggatgaaggctctaggatggcatataaggtagtcatcaattttattattggaaaaggacatttaaggtagcctcttgacttttgcttatattgttagttggagtcgtccttgtagatctctggagatttccctagtgccagatttcttaaataatcatatatacaaatatatctgctgaacgggtagatacatcttatttttcaaacaaaggttttgtcttagactgggttcttctctattatgtctacagtctaagttgaaatccatcattaataaatagaaaatatcctatcaactctgcatgggacttatttttatttacttataatttgggatgctcattgagatgctctatttaagaagtctcctgccctcagaggtaaaagcaaatactcatgagatttctgttcttcatctcgggcacttttaatgttccaaatctgaaaatctgtatttgtcaccaattaaaccaatctacaggaaactggctctttgacatcactggacaatggagtagacagtgtctgagtgagtggtcactatgatgctcctcagatcctcagtgattccacagttttacaactcactagtttttgaccaacatttcagcacgcatgtttatttgcaaaaatactgttaaaattctgcataagaatccataatattatttcacagtaaatttatttgtgtattctttatgcctataatacacctttgttcatatacagtttttcattattttgggagatatcccgcttgctaacattgtattggaactttagaaggaataactaatttgtttaattcttgtgttcttttcttttccctgggcagcccagcatataaattattaataatttagtgctaatattaatctcattgaggatctacagtaatttatgtgcatgcatttaagccttctgtcattttgataaaactccctttaatctgtagtatgtagataggggacaaagtcacttaagacctctcatattaactctgtctatatgagtggttctcagccatccaaatactacaaccctttaattcagttaagcatgtttgggtgaaccctaagcataaaattatttcattgctccttcataactgtaattttgcaactgttatgaattttagtgtaaatatctgatatgaagtctctctgacatgtgattgctgtcaaaagaccatgtaatccctaagtggtgaagactcacagattgagaaccattgatctacatccataatgagaaggtacagttcaaaacataataaacctttagtataaagcctgctacttttttgatttcctacttaaaagttttgtaacacaaaatcagggtatggtaataaattccatattaatatataaatgaatatatgaagtattaataattctttttcttaagtaacatgaaaatccatataataatataatatctcagccctatgtcttccaatttatttactatcaaagtaaaatagtgagttttctactttctagatgactataattgaaatctgtgatcattttctgttcactgttcaatgttagtgtatcttttgttaccattaaaatagaggtataatcaatcaaaccaaaattttaaaaaccaacaccaacctaagaaatagaacacagtcagtgtcttgctaccaactgacttattttgataaaaatttgtttcatgtgtgttattttgggaatactttttatgataggtagcctagaaaacacatcaagaacttttattaaaaataataaaggtctctccaataactctctgagatgtagtgccttgtaagatgcattcaagttcacaggggcacttaacttcaaaattgtggagatggtaactcacagctttctgtgtattcagtggaagcaccgtagaatataaggattctgcagacaggtctctgggatgttatctctggctgccttttatctaaatttattatgttcaacagtgccacgcacaattccataaagtagtagataactactatacttcctagatataagtgtctcattgagtatcaactagagattctccagacactattttgacacaaaatgggctcaactgcttgggtctagctgctgccctcacctgtctttgtggtctacaaatggttctaaattgatgaacaaatcatgttcaagagagttttaaaatggcattgaattaagccaggattaatactgagataaaggcagttgagggaagtgagctataaagctccttcatgtatcactttcacagcctcttttcaaggatggcaagccatgctgatcaatgcatttctaaactaaaaccaggaaaatcattacagatgccagattggaatgatagctattggctgcttttgaaaaccaagcaacaaacaagaaaacttgatctcactaacagtaaaatggcctagtattcaaagttggtagatatggggcatgttaaaaatctgaagtagtggaaatatttagctgagaaaattctgaattttgaggaaagattttaaatgacagatttttcttaattataaaatataaacaaattcacacatattagagtattagacagtaaagttatcaaatattttataattttaaaagtatgtttatattctgctggatgtatatctatgtatactacactttatgccatatagagatataaataaaaagcatgaaggtgattcaaagcaacaacgacagaaatttttgttaattaaaaactgataagcacataaatatgttgagacagcaataagaaaatataactaatgcatttcagaattaaatctcatggaaatttggctgactacagttcctaaaatttcttgcttaaatacagatttttctctttgaatatgtccattgaattgttacactgtatcattaaaatatgttcaattgccatggtttcactatgaaagaactgttcctggcaacattttgttccagtagcttctggaagtcttcattattgctggtttgaaattttacctttaatgttatcttatcctgagaacaccacaaataagttttggcccctcaactatattgttcattgaattttccagtttaatatctactggcttttccaattaacattaaagaattgtgcaatgaaacttgcaattatttgagaaaaaatgtcttttactccaaatttcttccttccttcttttttccttccttccttcctttttcttttttcttctttctttctgttattccttctttcctttcttctttctttgttttgtattccaagtttacatttcctacatcagtaggaaattatcacatgaataacttctttaaacggacactgaattccttctctctttctctgctctctgatatgacagagagctttgttgacactcttcatggatatgatatgaaataaaaaaaataacggatgagttttttcagaagattctcaaaatatggttctaataaggttaataatgaacttcaagtttattctaaaatagttgcataaatgttcatcaatacatttataagctctgaaaaattaaaatgctcaagattagtgcaacttttaagttttcagaacaattgcatgtcgagattattcatgaatcacgctgacattactttgctctaaaagtaaaatttcattaaaagaaatttatttaatttttaagaagagctcttttctcttctcttttgtaatgtcaagtatgtgggttttccatatcaaacatttctccaatgcaagatggtcctcaacttggttcccaacaactaacttcaataccagtgttagcttaggagctgatcctatttggttcactgcatgttcagcatcacctgtaagcagcagatccctaaaaggctgcagttattattattttactaaaatccaatattcttatggcccttcctcatctcatatgctaaacacattagttaagcactacctgttactaaaaatgcagtgaaagaaacaaagaacataccaaaaaggtagatgagacatgcaagggctgaagcacttgccctaggagttggaatgcaccacccttccaaagtgtaccagcctggaacttctctgcattcatcgttctgggatttgatgaggcttgccttaaatagacatggttgattaactcataagccatgcaattagctcaattgccagcctcccattactctctacagaagtcagggtgaagctggcatttccatctgtctaatctgtggtttctattctgccctgagatgacactttactaccaatgatatcaagtcatgaagacatgaaggcacatgtcccctgtgtcttctaggggacaaggatgttgtatggcttgttctgtaatacttacccactgaagtaggacaagactgggttatcactgcaaatgtagtcttgtttgtttccatttccattcattgatccataatgttctccaaaaagataattgttcagttaattttacatttccaaatctgatttagggctgtgccaggaagaaacatgatctcaactcttaagatgtttgattaaagtatatgtaaagaacattttgtaagaaattgtattaaaataaataaaggaataaatatctgttctcattggaatattttaatagttataattttgacttctttctaatgtttgttgttttgactgcagacatgctggttttgagatttcctgagctcccattagaatttggcttctcatttgctgccatgctttggataagacctgattacctcttgtataaaaatgtccatgtcagttgagttttactcccgtttctttggtacataagtccaagatacattttctgagaaaaaaaaatcgtccttgtttttctcagcccttgcactgagcctatgtttagacagccttctctacacacctttaaaccagagtctaaattaatgatagtgtacaacatcaattaatattggaatcttttgatgtattggtcaatgaattggagaatttagaaaattaagcttttgactatgtacatatactgtctgtatttataaaattttaaagatatttgactgcaagagtaggtaaatagataaaattaggcactagaataaatgactgtaagaacatatggttcatggatgttttcccctgagcaatatttaagtagatgaaacttcttgttaggcttcctagctctttattcttgttctttttcagtctaatgcttatgtttatcaggcagttagtcacttcctcaacatcttaaggctacatgcaatccacagattccctggagaaagcaccatcatatggaagtgcctattttcacccagcacagtggtttaaaggaccaattctctgcttgtgaatagaggaaatatactttgtgtaaaatgcattttaaacattgttttccataaaagagtaaaagcaaaggaagaaagctagtgattagcaatttccataaaaactgagcttcagtattttaatccttcactttacactctggttctcaaacagtaggtttttactcataaaatgattttcatcaaccacaatatttcaaatcttccacttacttatggttactcttcaaaagaacatgcttttaatctatgaagtggagtaattcaggcattttactgaaccaagagtctttttaggaagtagcttctgcttgaaaaaattgtagaaattttttagaattatgtgatgtggaaattacactggtacagaccaccttttaactgtttaaaaattttaaaaatatacaatgaaatggagagaatttcactctttaacatttaaagcaaaaccttcatagcaaataccatggatggcaaaccaaaggcctcttatctacctttctaataataatctgggaagtggataagcaatacttagaaaggagcacctgctgtcacacttgatgacctgagttttaccctcaaaacatgaatagtagaagaaaagacatgtcatggcatgagcatacacatgcaaacacacacacacacacacacacacacacacacacactcacacaccatttagaaagaaataagagggctagtgatgagaatagccaattcagaatagaaaggcaccacatgtttccagtggtgaaggaggaatattggaccattatagagatcattttgattatttcagctatggtgggggtgaggagaatagttaagtgcatgtgtgtagtgtacagagaggagaaatgcagttaaagatcctatatcccagaccttcttgtctctccatcacagcaaaaaatgatctttcccaaaatagtgctaatgatgagataatctgtatttcagaatccctatatcttacaaagaaaagaaattagaaaataaaacttactgtttttgtatacaaagattattaaatggattgtcttacatttttctattaaatttctatgtactaaattacattctctaccatggacattcatccacatgatttttgtagggaatgaaattgtttcagaaacaaatatcaattgttgttatgctttgaataaaaagtccacctacccaggctaaagtatgaagatttgttctccaacaacttgtcctgctgggggttcattggatttttattaaagaactcctgagcagatatctatggtaagtctagaaagggatacatcacagggagatagactcagggaggaactaggtctttgtgaatttgactttgatgagtagacctcatttcaacacttctctgctcttgttctctctacttcctgactgtcaagaggtaagcagctttctgtcatcatgccattcaatcatggtatttctttcctttcatataatccatatacctatgccttgcaatgtttgaagtgtaatgcaatggtctcaaaatcattatttgcatcctttaatttttcctcaggtattataccaccttgctgataattgacaaatatagaaaattggtatgataaaatgaggctgccactgtatctgactgcatgagtcaaaggttattgtaattgatttatgagttgaatttcaaaaatttagagaagcattgtaggcagaccttaattgaaggttttggcaggtgctcagaagaagagaatgccagttaggaacacaaacattaaagaccatacttgtgagggttcaaatggaaacaaggattctccaaggagttggatcacttttgccaagtatttatgcgtatttgctcatgttctggacctgtgtgtacacgagtaatgaactaattaatgtggtggacaaaatttcaaggtagttgttttagtgacttcttcatttctgtaatacaacacctcatagaagaaaaccatataaaggaaataggatttattttagatcatttttgaggatatagcccataaaggtaggaaaaattataagacttcatggtaatagtagtatgtagcagaaaattcttaaataacagtggagtaggaaacagaaagcattaggccaggtggatctttgttctgttgctgtgaagagacggcatgactatgcaactcttagaaggaaagcatttaattggggcttgcttacagttttttgaggtttagtccattgtcaccataatatggagcatgatggcatgcagatagatatggtgcttgtataaggagctgtgagctctgcatcctaatccacatacaataggtcttagaattaactttttgaaacctccaaatactcttccagtgacatatttcctccaataacaccacatcttctaatctgttcaaataattacagttcatggtatccaaatctatgaacctataggggctattctcattcaaacactcaaaagagatgagtataatctccaacggtatataaagagtgatttatttatgcaccccaacccactttctagtagtttactagcaggaaactgagagttcaaggcacaaacttatggagtgtgtttcagatacaagcatcctaaaggctcacattccctcataatgtaaagtacatacaatccaacttcaaaagtcctcatgattgtaataataccaacactattcaaagatcaaaatctaaagactgtactgaggtacaaacaatgtcttagatgtgaaacctgaaaaataattaaaaataaagctatatatttatacaatgccacagaacaagctccaactcagaatgaaagaggaacgaagactaagaatgaaaaatgagctgggcattggtggtacacacctttaatcccagtactcgggaggcagaggcaggcagatctctgtgagtttgaggccagcctgatctacagagtgagtgccaggatagactccaaagatacacagagaaaccctgtctcaaaaaaaagaatgaaaaatgaatgacaagagaatgaaatgaagtatggtaaacattatgactgcatgtccagaaccagtgctgcatagtgtcatctgagctccaatacagttggaaaactttactcacatggccatagaaaccatttgcaatggtctttggctcatgccattaggtagagtaaaggcctcacttatagtaccaattttctgcatttttcaattatcatcatggtgatacaataacggaagaaaaatttaagggagaaaaaggttgatttttctatcatgatttcagatatatcaacacatgcctatctgatatggcaagagagaaatgccaagatgatagggcacagtgccagaaagctgctctccttgtggcaactgggaagcagtgagaccaagaatagaaaggtccagggacaagatctaccctctagaatatgttgctctctcttgaggtagttcatttggtgcccacctcttgctttaacaaatgcttcatggcatttccaatattctaaattctccctccactgatttaggaatggaacctgatgttttacatgtttccagatcttgcaggcttttctgtggaggattgtttcaagcctccatagttatgaaattcttatagtcttcatgcttgcagaactgggacaatgtaagactaaattctattcccatctttagttgtagccagatttccattcaccatgttcaagaaaagaagtcccatgattctcttttgaaatgaaagcttttcacggtgatttgcaacattctctcttgtaacttgataggtgaagttccaactttgccacagtgaaattgcacttcttcttgacaacacgaatccattccatagttataactgtcatgactaggctttctttgtctgcaaaggtaacaatgttcatatgcctttccttaacaaactgcactttttttcacatatttttgttcttgtttctctcttctgaatctcattattaatgtggctgaaataagcaaatataaacaccccacaacttaaatagatgtcttaagtttttctctgttaaaacaatcctttagaattaaactttgcccaaatttcaggacagtcaaatcttagtcaaagtatttttctgaatataatatgaatgttttttttctgtctctcccaacagagcctctcttgccatctgcaaccttgtaagtacaatcttaactatccacatttccagaagcagttcagtgttctaaacctatataagaatttcctgtgacgtggaacttaaatcatttagcagtttctccactccttatcttcaaactccttcatactttccccacaaaccagttccagtgacccaaaggtcatgtggtaaggtttatcagaattacgacttcactttggggataaatattcgaagttactgacttgtttttttttttatgaccaatataactgacatgagtgattcaaaggagaagtgtttattttgacttttgtttagagagtaattttcatcatagcagagaaggtttggtggagttcctgccactggaagcatgtggcagatcatcctcatccttacttcttagtggattaggaaggagaaagagcgactagattcaaattgttcaaagctgtttctaatgatctgcttctgacatccatgttccacttcttgaagtctcacagccccaaacttaatgcaataagcaaggtgccattgctcaaacatgagcttgtgggaaacatttgaaattcaatccttaacagtaactaagcatggaaggcagtttttactcaaatggtgctggctgcttttatccaatttactgaatagaaggatttgaaaaataagaaatttgtccaggaaaggtatggtttctaaagagattggaatgttctaaaaaaattctaagtgctttgaattgggacaatagtaaagacaccttgagagaatataagaaatttagaaggttctgctcatttatacgctcatgtatttggggattttaagtaatatgaaatcgtttgctttgataaaggatgtctagagtatttgctcactcatggctacttgtcaggctcttagacatttggagtccatatttaagtatagcccgagaacttccatcctttgttgcatgtttcacagaaacacagaatctaagagttgaatcatcaactgtgtttatattggtagagatttctacccagattcaatggaaggccttcctgttatcccagacaaagtctgacaaggtcatgcttgcaaccactagaaaagactgtgatcagattgtgaaagactatttagactttggttaaaactccaagaatataaagatgtcatggtcctggaatgtctgccaaggaatgccaaagacaacaagaatagccatcccaggagagaaactatatgtcttctatcaataaggctacagaggtgtacttatccaaagctttcaggtagtgggtctccaccttcttaatttaatacaatttctcatctggtggtgatccccaaccataaaattatttttgttcctacttcacaactgtaattttgctattgctatgaattgtaatataaatatctgttatgcaggatgttttatatgtgaccttgcaaaggggtcattttacctctatttggtcacaacctataggttaagaactgctacacatctttgacgctggacatgcagtcacagtacttaatattccctggctccattaagttttccttagttccattcatcctttctaccatcctttcctttttttcagattgggaatgctttccatgcgctcttttacattgatttactagattatttaatttttgcaatggcacacaacaaagtctttgacttgagtctcagaggaaactttgagcttgaaatttaaatgatgagctttgagttttgaggactatgatcctcttgaagatggatgaaatatatttttattgtgagacttttggaggtctttgtgctttgcaattgatgcattctccatattcatttgtcatgctgtccataaggtagctgatttaatatatagtcaggttgacacgaagattatctatcaaaaaatctacttaataaatatacttatttgttaggtgtagtgttacctgtgtggttaaccatcagaaacagactgacccttatatgagtaagccaatgcataagctttgtcactacccacaatggctaaggcatatttattggaatatgttactgtagacaggtgctcagtgaggtcattttgcaagttctttatgctgtttctgaaaatttctcctcttttgtgataagataggttctagatttctggcatatggtataattcttaaaggtttatgtcaatgctttattgctgtttatgctcacagtatatcaaaataccatacacaaaaagaaggttcaaggtggttcttccccaagtttaggagatttgtttagttggcttagtgtttgtttactctatcctccatatctatgggtttccagacaagaatatggtattcggaaatggcaagagggaaagaatatttagcatccccttacataccaggagaggttatggccacatattcatctccaattttaatacagtccctcaagaagtattcattgcagaattcaataaacatttcaggtttatcaaggattattataaaaggcatgatctaattttcaaggcattgcatgtagttgctaactggtgaatttgttctagtcaaacaaggaaagttaaataggatggtgggactcagcttggcattgtcatattctattatgacccatgtttttttcttgatttgagcatgctggctaacctcactctggtctcaattgcatgaaaagtagagggatgtgcaataattccttgtcttttgagtaagccaatcccatttgatgagtatttccttatgtgaaaattccagaggagtgatatcctttagatgaagcactttgttgttaactcagttcatgatactcttctcattagttagggcataacaagactcatagattttgagcaaccagctttacctaaacagggaatttggttttaatactctatacaaatcttcttggagtcatacctgtagtagctagtacttcctggatgaaactgagcacagcttgtaccaagatttggtttcatgaaggatattttggaaaactgaaaactgtttaaaaatcctgttcttaacaaactagcttccttcagtttggagcttgattgttattttttgtcagtgttgaaaaacagaataattttatcagctttctataagatctatcagatatctgaggtgaatgtgccagaaacgaagttctggttaatcttgatgtcaattgacaagcttctgatcatcctggaaacacacctccaagactgcctgaggatgtttccagaaagctttaactgagcaagaaagacttctaaatctacatcataccatttcaaggactaggatccctgactgaataaaaagagataatatggactaaaagacacaacactcattttcaagtgcatacataagaaatagtttatttgggagtcaaataagagtagcattagcccaggaacatagattttatttactccaaatttcatgttacagtacaaaagtagtattttgattttttagtaaaataataaattaaattatcaacaatggttcttctcaaaagcattgatatgttaagtaagtggatatcctagttagattgggtcaagctgacacaagctggagttatgtgggaaagtgaacctctattgaggggtagcctccaatagattggcctgtggtcaagttgctggagtattggattgaatcatgatttatgtgggagatagaagctcgctgcagttgttgccgctcctgcgcagctagtcctgggtattagaaagcactgaaaaagccaccaaatgcaagaaagcaagcagtgttcatgcatggcatctgcttcagttcctccctcaaggtccttccttggctgcccttcataatgactgattctaacagtaagcttaattaacttctttcctctctaagctatattggttattgcctttattagagcaatataaaccaaactaagagaatagatcaaagaaaattggagaaaaaaattcaactgtagagttcagacaccttagcttttgatcgatagaaactgccttttcttaagttaatatattcctaaaagttttttatctgttagtcccaggctgctgcatctgacaaagacgtggtaaaggaatgactatttaggaagataacccaaaataaaatgtaattaggctttgaactttatacattccaaccttccatcagtgatgttttaatcagtcaattagtctttacagacagtttctttccaggaatcctcagttataccagtatcaattcctcaacttctgatggtggatgcagtttgatcaactgttggtatacagatcccaccagagatgaccactctgaatagattatacacaattgcaagtctttattccagctggctgggattatgctctggtgtttgggacttgtttttagggtaaagaatttataaagtaaaaaaccacatcctgggagcttgctcagcaggtgctgtagatggaaagtttgcttaatcaagcattttatcagaagctaatataagcaattaggtagaggtgaaggtttacataagcagacaatttaacagaaactgttagctgtggcatcttgacctcatatttctgggatagaatttggtgattttccactgtagtatccatcaaggagatcaaattctagttaagcctgaaatggtctcaacaagcatacatgatagaggaacttctgaactgtctttgcctgccataatctgttatcttctttctacttccatgcttccccaccatgttacactgtatccttgaactgtgagccagaataaaaccattccctctcaagatgcttttgccagacattttactgcattaaggatgaaagattaataaattacatttttcaactaaataataggcttctgttactgaggtggaccactgtttacggcactggaaataggtttgccttctgaatttcaaacatgtctttgaaaggtaaccaactaggatcatcttgtttcttagatagaacattgtacactccctttcagaaaaagtcttgcttgagattaccttagtctttgagacaaagcattggtcatgtccttcaagaataccaaaactgagtttttgtgacagagtggggttatattcctactagtatacaacctctgtgaagtagaagggttattaagttccttaaaagggatgggagaaggtgtagagatgattcccaaaaagtggagacacagctgactcttctgagaattttctctttattgaataatatgggataatcattcaaaactagctgggtgttggtggcacatgcctttaatctcagcactcaggaggcagaagcaggtggatctctgtgagtttgaggccagcctggtctacagagcgagtgccacgataggctccaaagctacacagagaaacccagtctagaaaaacaaaaacaaaaaaagtcattcagaactatatttgtttagtgcaagaatactaattggaagcactctagtacagagtttgcttcccatgactattacctctagggaatgataaggggccttaaagcatcaatgctgcctgtgcttggataacactctgaaagagaaccccaaagagtcagccatgtcattcatttcatagagttgaactgtggttactgtggtaaaaggacagttacctacttaaaggtgatgttgtagagacatctggattgctttgtggagtagcccctgatctttactggaaaaggtgatggccaggtggtaactggagggtttcccagaagaaaagccagttatagacttttcttacattgctaaacaactgggactttcttttctagtagggtatagtataatttgcttattcatcttggtttcatacccagaggtttattgtatgagggcagtctcactggaagtaatacattttatataggctgtttatggaattagcggacaacactatctttcagtttatgtgttattttctggggaaccactggcagctgtggtttgattaattgagttacattcttatgattgcagagaaagatggcttatatggcaagaagtactggtgagatggaaccaagtaaattctggatatgtcagatgcaattttatacaagaccagttaactggcaaatttatgaaacattcttagtagaaagaagacatattgaactttggtttacatgttcattcacagacttcctagatcttaatgggactgggtgaacttcagtctgtgcaagcctatgtgggaagcatggaggtccttgtgctcacagataaacattagagaacctggcatgttaaacacattgggttctttattcaaagaaagggaagctataaaaggaggtggcaatttcatttcttggctgctcagtcctaaaataatcacacagaagcttattagtaattataaattgtttggctcaggcatattactaagtagctcatagaccttaaattaacccatttctattaacctatgttttgccacatgtcttatgacattacctgttcactagtacatattgctgctctggagactcaatggcatctatgcaagactccttccttctccctaccttcttagctttgctttccagcctggctttagcctgcaataggtcaaatcagcttctttatttacaatagaaacaaaatgtaatcaaagcatagagaaaggttactgaagagtgaacagcccaccacagatagtgctagggttttctttattgagatacacaaatcaagtgagagggaaggacctggaaccagtgctgatagccagggaagcagaagagagaagggccagggtctccacatgcagcccttagaaccttcccttacatcaaccccaacttcccttcaccccgccctcatgggcatgtccccagtacacctggcacctgtccaggttgcctgggacagggctagggtgtctccctagaattccccttttagtctaaaagaggattaaaacttaatagtgtaaaacatctaaaattagcaatcataaaggtgaaatataagaagatacaataatctgctattgcacatcctatgtctattccagctaagccctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaatgctagtacagggaaagtctctaatgagttatgtctagttcatgttagatgagattttattgattgaagatctaggttgaaatcctcaacttgattgaagtcattactcgaggttctggttggagtgtcagtagagatggagtgagttgaatccagtgcagtcagggaggtgtagtccaattcattttccggagcatgcagggattgttgtcaggctggttctcattggctgtatgggactcaaacataagtgtcatcagagaaatgttcacttttacatgtatgtgtcctgggaaaggcaatccttgaaaaacaacaattatgagaaggtgtaggccttgaaagaaagagccaaaaaagatagtcctcttattcttcatttattctgtattacatcaattggcttcttgatataacacagaaactttaaaattttgttaattaacatgcttggattttagggtaggagaaccaaatccaactctaaatccagcatcaatttaattgaatagggactaggaaatgaagagaaatagagttatttgagagacatctgtaaattttaccgtatggcacgttccttttgttggatgattatagctacgttctttccttaagtatctacacatgtagtgtcctttgacttccggaggtgggttttcctgtgaggataaaaacaaagcacttcccatcctttgggaggcttttatttagttcgtgatatatacaacagtaaatatctgtcagtcattctcgttgagagggttgtatttcaactcgaatcttgatcaattttgatggtatccaaagattttcttctcctgtggaaacaaatgcaaaacccctacccaaagtaacacatgtccaagtttccatactgaggtcagttcatctttgaaatacactggttggttcagttcagcagttttttccatactccagtgtctttccgcagctgtttgtccattgtcattggcattaagaaagtttagcattaataaagcattatgcagtctatgtttggggggtttcgagttaccagcttgcctatggagcatctccttaagagtcctgttagacctttcaacaactgcttgtcctgtagggttgtgtggtatacctgtgacatgcataatattataatatttgaagaactgttccatttttgtggagacatatgctggagcattgtcagtttttatctgcaccggtatgcccataactgccattacctccagtaggtgtgtaataatggaatcagctttttcagagttgagagaagtagctcattggaaatctgagaatgtgtcaatggtatgatgcacatatttcaaatttccaaattctgcaaagtgaaagacatccatttgccagatctcattcctccaaaggcctttagtattacagccttctggcatcggagtttggttataaaaggagcaagtagggcagtttctcactatctccttggcttgttgccaagtgatggagaagtccttctttaaacccttgctatttacatgatgctttttatgaaattctgaggcttctagcacattgccaatcaataaatgatcaatctcatcattgccttgtgccagtgggcctggcagacacgtatgggatctgatatgcataatgtatagtgggttacttctgtttctgattgtttcctgtaactgcaagaacaacgaggttagttcagtattatcagggacgaattctgcagtctctatgtgcaagatgtctctctctgcatattgggaatcagtaactatattaagaggttctgtaaaatccataagcaccatgagaattgcatataattctgctttctgtacagatgtatatggactttgaactactttacttacctcacctgctttataaccagccttacctgttttgttagcatcagtgtagaaagtaagaacttcagaaatgggagtttgtcttacaatgcgcggaagaatgcaaactgtcttttttatgaatttaattctgtcagttttgggatagttgtactaattgtttccaaaaagcaggtaagggctatctgccaatactcattatccttccatgaggaggaaattttatcattagttaaaggtactataatctccgctggatcttttccagtcagctgatgaagtcttaatttgccctttaaaatcaaatcagaaatctttatatgcctttaactttcgttttgcttatgtggcagaaatatccattccaatatagtgtcttccctctgcatcagaatcccagaaggatattctctggatggcaagataaccagaatgcagactagatcaaggtttatccgatctacatgcgcatccaatattctgttttctacccattgtagatctttttctgcctcaggagataatatttgtggactgtttaagtccttatcaccttttagtgccatttttaaatgttttaagtcatgtccttccacaccaataatcgtctgtaattgagaaatttctcctagtagcttctgaagactgttaagagtttgataacggtcccttctaatttgtaccttttgaggtctgatttttgtaagtctgtcttatatcctaaaatagttaatagaatctcctctttgtatcttttctggggcaatttgtagaccccatctagtcagaacctccttcaccatttcaaacatacgttccaaagtttcctcattagaatccgattaaagaatatcatccatataatgataaacaagagattgtggaaattttttatgaattatttccaaaggttgttgaacaaagtgttgacactaagtgggactatttagcatcccctgaggtaaattccattggtatctccaaactggctgtgagttatatggtgttggcactgtaaatgcaaatttctctctattgctttcttgtaatggtatagtgaaaaagcagtctttaaggtcaattactatgatcggccatcctttaggtattaaggaaggcaatggcattctaggctgtagagagcccatagactgaattaccttatttatggctctcaggtctgtcagcattctccagttacctgacttttacttgataacaaatacaggagaattccaagggctggtagattgctctatgtgaccagaatctagctgttcctgtagtaacttttctagagcctcaagcttttcagaggtcaaaggccattgccctatccagactggttcatctgtaagccatttcaatgatagggcctttggttcctctaaaggcctatcatttgtatttagtgtctgtacagcctggatagttggtaaccattttccgtggcatcttacctgatcctttctactatccggcaattttctagaattcgtatctgacactggagggatgttaatttgagtattccattgctgtaataaatcatgactgcataaatttatagcaatatctgctacataaggtttcagtcttcctttttgtccttccggtccaatacagaccatcgagttaacactctgtcgaactctagatagagttccaattcctaaaaattgtacatttgcctctttaagggaccattgcttaggccaggatttctgagtgataacagctccagtgtctacaagacctttaatagctctgccattaatttttctaactgaggccttttatcattaatagaagcttgccaaaatatgcatttctcattttcactagtcacatgtgattcttcatcactattcaaactaccttctagagcagtatcattttccacaataggcaaggaactatctattcgtcctgtgagagattgtcttccactgtcactgggaacgatcgaactgttctcgaggcgggggcctgctggaggcccgattcagagtttcccgatgtcaataggttcccttgcaagtccctagtctatctgcatttgttagtccagtgtttgtccttactacatctcctacataacccagagggcaatgacctgtcacgtgaggaatcgttagaatttctctgtctacaatttctccttatatgtcccattttaccacagctgaaacatctattcttctgatgcttctgtggactcctggagtgtgctcttccaagtgaggctatgggtcatggtggcaatgagcactggcctctaggtacctgtgtgagcccctgtaaggtgctcttccttcccaagtccttctgttgctatcttttctaatctcctgctgtctgttgaaacctcttgggacagcttcttctgcccagattccagcatcttgtatgttacagtcaacatgggcagtatgcagaacccattcttctagtggagctgatctgatctttagatgcaaaagtattctttggcacattgggtttgcattgtcataagctaagctatacacaattggatgtcggatctttggatctgctatctgtatgtctactgctctggtcagtcggtctaagaagaccttaaatggtactgtttgtccctgttctatttctgcataagcttctagttgttctcctgattcacaaaccttgtcccatgcatttagtgctgctgttctgcatagggacagcatatggttgtcatattcagcctgaattcgtgggtcagcataaataccttctaggattttttggatgggtgcatcaattctgtccctggtggcttgccattctaggagtctgccttcttccctaaataacgctctccactcaatttggcaagaattctcaaggatagctgatgccagtcctacccaatctgagggtgttaccctgttaaaggtggaccatgaatacaacagttgttttacgtatgggctatgaagaccatacgagacaagcaattctttaatatgcctaagatcctttaattgggttggttgccatgtatatgctgtctgcccctgggagtgttttttagatggttgcttgtccaccacaatggccgggtagactaaaggtgtgtgtgtaactgctttaggatgattgaaataacttttcgaagtgggcatctcagatcggagtgagtctgtgtcctcttcaccaaattgatcttccagcctgcccaggacatcctcatgacaggctttaatctcatccatcatgaaagactccaggcatgatacagaatttgcttcgacaattctcctgtaagattttctagacgggtaatacgttcatccctagctagcatttggatggcaatctatagccatccatagattgaaatttagaatcaaggttgtgatttgcctcagcaatcgactcgatagacatttccagtttggtaacccaggtctgtaactcctcctgtaagctttgaaactcagtcctaagttcactatagtccctctcacacttcccagccattgatttagtggcattatctgattgttgaagcctattctgggtatcttgtaccttagtaacaaaggaataggagaaagagcttgctgagtttctaactggctgcatacgccctgcaatgactcacagtctgctgccttcctagccattaaggcaccatggtctgtagcctgtttagtctgtagcgtccctagactagatttcagttcctcatggtctgtagcctgcttgatctgtaaggtctgaataagttcctgaatctcatcatggtcctttgcctgctcagccagtaaagactctaagatgtagcatctgtctatttttatgttgatataaatgtgctgtacttcagcttgattagtagacagatctgcctgcattgtatagaacatagaatgaagcctatcatccagtttctgttctaacagctcaagaagcattgtataggtcagtttcgattcatctagaacctggctatgtaaggcttgtatgttctgtgaatgggtggagaaatcagccttcctattgttcctgaggaacaacaacatgtgaattaatatagtcgcagctaataagacatataagctaatatttagcaagtcagcctgttcctccagcactgaatgcacataagcataggagaggttatacaagtctaaatgcaatgggaattcagccatatttattggtaagtccatttccgggtgcagtaaccatggctggccagaaggtggcgcagccgcatctattttgagtaggattggactcacagcaaacttttttttgccactaaggaaatctttagaacgtacctggcaggtatttgcgtcaggcaggtggccgtgcccacatctagagttgaaaagcttaccctgccagggtctgggccagcagatggtgggcggggctctggaagaaagaggcctcagcgcctaggtggagacaggcacagcgggaactggggaatagtagcagcatgaagcggcagggagcgttccctgtggattaaagctggaagccctctgctgtgccctaaatgcacacacagctaaaagtgaatgtgcgggagagtgcgcctggtgcatggctgttgagcgactgagggatgctggcagcagggcgccggcggtgtggtgggaactcccgctggtggcgtggagataacagcggcggcctggtggggcagcgccactacaaggaagccgcaagaagcgctcagctgtgcttgctgagccgctccagaacacagacagagctagatttgaattagcgggagtgcgcgggagtgttgaggaaggagccactgaggaaggctgacatctgagccactgaggaaggcggggatggtgggagcttgcgaccgcggctgagaggagaacccacaggttttgggcgggaagtaccagggaactcaattcaccggtttttccatgctcaagcacagtgcggtcctgtgcatgcggtgggtctggttgggcgccacattaagagtgaacagcccaccgcagatagtgctagggttttctttattgagatacttcaatcaagtgagagggagggagctggaaccagtgacggtagctggggaagcagaagagagaagggccggggtctccacgtgcagcccttaagaaccttgccttacgtcaaccccgacttcccttcagcctgccctcatgggcatgtcctcggtacacctgacacctgtcccgaatgcctgtggtggggttagggtgtctccatacaggttacctcatggcttctccccatttctgtctaggcaaaataaaggtttcaactttaacacagtaaaattacatatcaaataagaattatagttacaataattagtctatttgtatttcacaaaatttgagaaaatacttactatctatcctgtctttgtgagtccaaagtttcctacctaatttttcttttatcataactaagaacaactttaatgttctagtctttaattccatcaaagacctgagaagaatagtattacctgagtaagcaggaagcgtgagcaagtgacttccaaaaatgtaagaaaagacagcaatgggtggcttcctagacaatcacccaaggtttctttgtagcattggggcatctatctttggcctacaggcctagtatatctgacagactttactgtgaagcaaggaattttgaaggactgtcctaccttgtctttgcaaagcttgtcggtcaactttcttggcattttgctggtccagtttggacagtaactttcagaaattgagaacagtaaaaagaacagtttttacccttgtggctagcttctgtcataaagagaaaaaactggaaatggactttctttgaggcccatcatcttctctggagtacattggtgatgttaggagtagctttgtctcactgtcacaaaaagtgtaagttactaaaacattttaaatatcatattctgtaggtctttgaaatgtctgaagaatacctatctgtctgaaatatatctttgtatatgtggaaaagctaacattattttaagtttgttaaagatgactaactatatttttagaaatctgtatttcttaattatacattgtttttaattgagctatataaacacaatgccttaaacaagaatatatatattctaaagctgcttggccaatgaataggatttttcatctgttagctcagtcttaattatcataaatctatacattttataagacttatcttatagaggatgcctttcactgtcaccttctcttgctgatggttcacatggtgccacgggaggagaaaggggaaaaaggaaacccttcctatctcctttgcttaattatgagtctccttgctatgtcacttcttgcctggatcaccacttctctactacatttcccagaatcctctttgacaggagaatctgtgaaaactctcaagaatttatttagatataaattgtgaataaataatcactaatatagaacagagtaaatgctgccatgatgtgatctaacctaaatttataacaataaactaaaatccaaataaatgtaatattttgagattaacagttgtttttctagtttaaggcagattcaataacctaccctctttctccattttatattatatccacctttattctattagaacgggactaactatgaccaataacaatttggtcatagttatatatataactatatatataactataaccaaactccttaaaatgaatataaatgtttaaaaacaatattttgggaatttgaacatagttctctagactagttcctgatgattgttgggtgtggtgatctttgagggaccctgagaaaaattgtggttaagtcttcactgtagtggtctgtgaggtttcattgtctcagccagttgccttgaagctgttctgggttttggaacatctggatcatcactcctattggagacgtttcaggagatcttccttgatcaaaccatattagcctaacaggaatccacagcttctcatcttctgtggaaacaaaaacagaatgtcttttccaaagcaacatatccttagacccaaatttcaaattcaagatatcttcaaaatatataggttggtttaacttagcagcccccacaatcaaatgtctctcagcagttatcttattaacaatcaaaacaaccaaagaaaacacaataatatacataatccatactctttgtgtatttttcatctttacatggcttattatatttttattactctattcacttaaggactttattattttataatcactctttcagtctatgactgtctttatcctttttcttatgtatttcaagcctatgtacattttgctattcacttggtgtttctttttgcctgaatctgactttactgtgtatcagtaatcattttctgaccatgagagtttttaaactcttaagcaggcttggctaggatcaaagcaggagctttggctgttggctgcattttgctaggctttccaacatgacagaggtaatgagagttatgcttacctcccaactgtgggaagctgtggggtccatgctgcgaccaaagtgtatagccattctttcaagccagtagacaatggtatcgagaatcctcttcaccatggcctatgtaagaggttatgggaacccaccatgcaaatctcgaagctgtgctctacagccttcaggcagacctaggagaatcttctttgtacctcagtctgtgggagacctgaggagtctgccatgatgctgctgaagccctctgtggccaggggatatggttctgtaccacaggagacagaactatgagtctgctcttggtttagtttttgttttgtttagaaccattttaggagtttttaggtcttatgtgtatccatgtctcatgttgggtgccatttgtaaatggaggcggtgcttttgtctcccagcaacctagtcccaaaatagttatacagaagcttaatattcaactatttgacctatttctcgcactattactgactaactcctacaactttaattaacccatttttactaatctatattttgccatgtatctcctggcattagctgttctgtagtacatatcacactactttagtggtgtgctagcatctgtcccagactctgccattctcctccctgtatttttcattgactttcccacctggctgaaccctgccttgctatagaccaaaccagcttctttattaaccaatgggaataaaacatattcacagcatagagaagggttatcctacagcaggaagaataatcagctatcttcccaaaggtccatagctgttgggagccaaagatctcagggcttggcatgagatcctagcccattcttggccggccacatagttgtatattaacctttacatagcagttccttagaacctcagctcaagaaaagaaacaacttgacccagtcctctacccataggctcagtcacttaggcaatccttcctggacctcttactcatgaactgtttaccctgccaaacatcctctttgtggctacctaatatcctgcctacactaacacctggtgcacaaacaacccattctacccctccccatatccagctctactgactatataagctagcctgagaaaaataaaatttgccacttgatcagaatcctgtcttgtggtcattctttctgtggctcttgtccccactccctatcccttactctcttgccttaggttgacctcctgtcctgcgggttgggacacatagcaggcatggctaatagtcttctgatctttgagctatctgtttgactaataccacactggaccttccttcatacctttatcaaaagcttgtttatcttagtcaattaaaaaaatgttttgaaggtgtcatatgtactttacaaataaaataatagtaaaaacctagaaactctctaagtgctacctgataaagaaaaacagatttagacaattcatttcaaggattgcttaaaaattccttaagcattaaattttagaaacagaaataaacatgcaattttatctgtagtttgtttacttgctgtacatgtatatgtgtgtatgtgtgcatgtgtacatgccacagcataagtgtgggttctgaggtttgaatttaggtaatgagagctccagggaatgagcttagtgttatatcaacccaggagaatctgtgaaaactctcaagaatttatttagatataaattgtgaataaataatcactaatatagaacagagtaaatgctgccatgatgtgatccagatcctgtgccctgctcttctgccaaggggagatagggaccaactgctccttgctctggctcccaccgaccatggggcaggggtggcgagcaactaagagcatattacctccctctcagctcttaagtggtcattaatgcagacaagactacactgtattgcttactgccccagaagttgtcgtgaaccggaaggcatgtctcagctttaacccatgaaagccatgagcttctacctgagaaggggtacatggacctggaaactcctagcaacccagcggcaataaagatgaaacacaggcatcttgtcatctttagagagctctcagttccatgctgtagaactagagtcatttctttattagccatctattctgctgtttcttaaccatcctgccagtaccacaagggaaccatttctctctttgttctcctctctcctctggttgctcatccataattcctgtcctcccaagtcactcatgcacctctagcacctctgctcaggtgcaggcctattcagatgcttaggcccacagagatgcaaataggaggcatattaccctgaggccatggtaaacaatagtagccttactggcattaacaatacaatagtgagccatagctttccagtgttccatgtttgcaggagttgtaggctgggccccaaaatattccataacagaattatttggtcccccacaagaagtcattggctaaataggttgaaatcccatagaaatttagtgacaagtgtctttactcactgagtcatctctcaggccccaacattgtttttcataaatccatttcaatgctaagagaaaaatccatcaagaatacaacaaaagagagggatcagagatggctcagacattaagagcacttgctgctgttgtagaggactagattttgattcccaggatctacctgtcagcttacgactaattgtaactccagctttagagaatctgacatgctcttctgaactctgccagcacttacactcacatgcatacaaattacacatagacacatatatacacatggttaaaaataaaagaaaaagcaaaaatgagatgcttacctaagtaaaccattattaattatgaaagtcaccagtaaattacttaacaataaaacatataaataggatttcatagcacagtaatagagtaatgtaccatgaaaaataaattctaacagtcacacatggatgatccaatatacgaaatgtttaaatgtaagtaaaacatgttattatatcaaaagggaaaaataagactgaaaaaaaggtagaattactcatctttgtagatggaaagctgtatacagcaaggtaatttctttgaaaatagatacaatgagatgtgataaaaaatcattaggttataaatcattatacaaatcatacatgatcactaagtatagcttcatctcaaatagtgacatgaaaacatatgaaaagattgcaaagccataccttccttttcagtaagaactctcagcaatttcttctttaaatcatgacttctaaattacttgagcctctatgatcataagccagccaaaaaatttgatactttataattttcataaaattatttctatatctgaatataaaattgcagacaacaatatttttaaaaactgagaggaaagacactaaccttattatgttaatgtatgttgaaaagctacagtaaataaaggaacaatagaaagacattctctggggaaagaaaaaagggtagggcttacacagaaaataagggctaattatactcttttgtcaagaccattgcaggtatagagtacataactaggtataggagttgatggagacagaatatgcatttacctattacatggaagaccaaggattatacacttaatatacgccagggaggaaataattttctttttaagaaaactgagatgtctgtccagtgttataaacagacacactaaagaaatgtctcaatggttagcaacacttgttgctcttacaaacccagctttgaatcccaatacacacccacagggctcacaactgtctgtcactccagtctcagggaacccattacctcatcttatcaggcacacaggtggtgaacatacatacatacatacatacatacatacatacatacatacatacacacacacatacatacagggtaaacaatcatataaataataaaaataaatctaaatgaaataataaataggtagtgataggatgagataagtctatgctttttagaagaaataacatgactaagctaacacaaatttaaaatgtgtaactccaagaaataaaaatatgtggaagcctttgaataatctgagaatcttgtttacttttttatttttaacattcataccagtaatagacattacttgggtacagaatatttatcagtgtttgttggtgatagtacaatttctggcatttattatttaaacatctccaagtgtacagactttcttcctccttcagtgatcttgtgttgcttttctagatatggctgctaaaatttttggattctaagtagagttcttgtatggatataagtacacacttatttatttattaatttttattttgtttatttttatttattttaaaaatatgtgtcaatttatctagtttactatgatgaaatgcatgaacttagtggcttataaacaacagaaattaatttcttacaggctggaaaagacaaggtgaaaatcatgacaccagcatattccttcctttgcaaagacactattcttaacatgggtaggaagcttccccactgtgtctgtcttatggcaaaaggcatgagtggactttctcaggcacattttgcaagggcagagatccctattcctgggtctttatcctcatggctaattacctccatcagaccacaccttttgtttacatcatgttggtctttaaatttcaacgtaaggaaggggtggtgggagggggcacttgaacagttacatgtttaggtccagagcacataacctaggttttcatacttagagttcagttttgaaacatttcttctgtttttccttcttggtctgtggaggaatgactttaatagttataaaataccattgtgaaagaactaagggcccaccatattggcatatagatgactttaaatagcatgtgtattacaacagatgaggaaagaaaccttacctgaacttcctttatctgaattagatagaggatgtctaacctgacgtggaatatttactgtacattgactctcagtgtagcaaagaagctcttcccataccatcttttaaaaccttgaatgtcccttcccaaatcacataccttttaaagatgaaatagcacagtgctttatccatatgaattactgtcccgttaaccaatgctttcatttagttagtagtcccttacttctacccttgaaatctgttaggtgacaaaatatgctcctaaaatggtggagccattgctcatgactcaaaatggctgcctcagcttagtccaggaaggccaccattaaaaaaaagaaacttaaccaccagcattgtcagaaatctcatagcatggaaacctaacttatcaaaaggtcacagctttcttgttcccccaatggctactccaagaaaaggaagagctgttgtccctgtgtgctccagtaatggactattttctacccctacaagtctgcctctaatctctgtcctaccccaaaatagaaaaaaaaaaagaaaagaaatctcctgaataaagggatccaccctgcaaaccctaggggatcctataaaacccgtttctcttccacaaccaggctactgtactcttctctactttcatgagacagcctgacattttgctatcaataaactatttttctacctaaagagtgatcttatttgttgttttgctgtgcttacaatctacattgataatagagggaagaagagagggctcagtatgtaaagtctatcactacacaagcagaaagcctcataactagaattttatcctcagaaattgtgttcaaaactctaccaccagtcttgctctttcttgatttcacttccaaacagattaagtgataacaaataataaatacaatctgccaatttctttttatttcttaggttaccatatttacagtttgcctgctctatattgtgcatactatctctttttctgactctttctcctgggtacactttgccaaagaaatattttcagacttttgagacacttatggaaacaagtccttaactgcatcctctataattaatagttgacaagttcatcatagagaaaaggagaaaatgtgtataatgatatatataaagtttatataatggaaagattatacaacacaaacttacataaaagaatagaaataaaacattattttgttcagtagatgtggccatttgaatcagtaagtgtatttgataatttatccgctataagggcattttaaattttgggacaaaattactaaagaatggtaaattaaagcaagaaactcaaaaacagaattattaaggcttctcttgtgatataatatgatttcctaggggccaaaataggaaaggaaaattagaacagttgggttggtgctcaatgtcctgtaggaagctgtgctttattaagctaattggtttctgtttagttctctacctgcctagggtgctttcctgctctgcccatgggtgtgctcaacttttcctggagggtgggagtgctctagcagtaagcagtaattatttcctcagtgcctggaactagcctgtcttgagcagttgggctgtagaactacaaattaattaattaattaattaaaaatggagtttaggttagtggacccatcacccaccctcaagccttgcagatctcattggtttaggaaatatgactgacagacatgaattaatagaaccaaacgagctatgaattatttctaagaaacaaatttaaaaacaaaaaagacctcatgttagctttgcacaatttatacttgtttgccatctctattgcaaacatcactgtgatgataatactcatatatatgcagtatacatatacatatatattatagaatcctattccatcactgtattttgatatcaattgtaattactaagctgtaaattgatttggtacagagtctaactttataattaaaaccattctgaatatttactggtatactcaaaatttagtgtcaaagaaattagttttgtcaataaaactttttgaaaagatatatgaagcaatacaaaacaaactcactccagtttctaatatgaaccttatgggtcagaagagtctaatgtctctcatcacacaatattacaggcatgatcaccacatatacaacaaaagaaaagacaagagaaaagtgtaaccaatttatttagctaagttttatgagaagtgggaggcttcaaaaatgaaagttaaaaaaaactagagaaaatagcccatttttatttttaagtctgagaaaatatttctgctaagattttggacaggagccctgactgtagggcacccaaaacatcagatgtggtcatttgctactctgggagtccctggagagataaagggtagagagggcactgatgaatcaggtgttgccacaccaagggaaggaagaagaggagtactgtgtatgtgtgctctgtcttctcagtgccaacaggagtgttgagaacaaaaactattactggtcaagaagggcaaggaccccatgtggcaatactgagatcatctttgttggagaccagaagacagttctgattatgggcccagctgattggaacagagggtgacacctgatcatgtgtttggtcaaagtagactgatgatctcattctcttccccctaaacttgaagtggttcctgcaacttcaggtattctgggagaaaacagggcaaagaaacaaagtggagtttgtggccataatgccttcctcttgcagggttaggaaaatatccagagacttctggggacaccactggagactgacacagaatttggagacattggatgctaaattgtccattatgatgtcccaatgaatcttaaaactatgtggtttctcgaatcagtgtacttttagcattaaaggaggaatgaggtcagataaacagtgtcagtgggatctcccagtgggctcccctctgctttccagtttcatgtctaaataatttgggggaaaaaaaagaaacaacaacaacaaaaaaaccaaaaatcaggagtatgtgatggaggtaggaataagttattgcagaatagataagaactctaaaggaatgagagtggataaaagcaaagagacctttatgtattgcaggttgtactccctttctaacatctttgagaccaaaagcatctttcctggggactttgctctgtacaggtgattgagtgacctttgggatgacacttacaggagagggaaatagtttgttcttctcacttctgttgacagtgattataaaacagttggggctcctggactggggtttagttatcagaccttctttgaagtttgggtatcacagggacagagctgcatttcgaatctcatttccatgaccattcattattgttgttgtttgtaacaggctgatggttaccagagagtgagacaaacccaaggcctttgtgtttgtttcttttctgttgctgtgataaaatatcctaacaaaaattaaattatgaaagtctttattttggcatatagttttggaaaatagagtccaaaattgttgggaaaatttggacacagggaagacatgatggtagaagaaggaagtttttcaaacatatttcaatttctcacacagggagcaagaacaagcaacggaataggaacaaagctataaagcctgaaagtctgcctccaatggagtacacccccccccagccagctcttgacagtttcctaaccttctcagagggtgataccatgggataggatgtaaaacgcttgaggttatggaagagctcatattcaaactactaaagtcctttactcctgagaatatttaactagctatgttagctagaaccaataaaccttatagtctagtctcagaggacaattttctttaacattatcttacctgtggagggctgtgagacatgtgattcaatgtttgaaacaacaaaggaagtagaaacatcagaaaaattggaaattacaactttttaattcttctttaactaaacagtgaacatttgcaagttcgataaagatttaaacaaacaaacaaacaaacaaacaaaccaaaaacattgttgcaaaaacaggctcaatgccttgttttaccttggtttagaatgaagacatagtacagaaaggtgatgtacagaaaggacaaaatggttttgtcctaatgattttagataagagagtgcaactcaataaggcctgtctgttcaaactcttcttgtctactttgtgttgcattccttcttccaagatatggtgtaggacctttgtgaaattgtttctatgtgtagagaaccacccctagcatcttcaggaacatggctcagttattttgtcatgagggtggagtggtgctggattcagtaatgctgttcacttcctttgcaatagggtctctcattgcccaacagatcaccaattaagctagaagggctggccagaaagcccacatatccttttgcttttgcctagtacactgggattacaaatgtgcactaccatttgtgatagtttgaatgaaaatctatgctggagaggatgtggagaaaaaggagcactcctgcattgctgatgggagtgcaaacttgtaagaccactttggaaatcagtatggcggttgctcagaaaatgggaatcagtctacctcaagatccagcaattcctctcttgggcatatacccaaacattcatacaacaaggacatatgttcaaccatgttcatagcagcattgtttgtaatagccagaacctggaagcaacctagatgcccctcagctgaagaatggacaaagaaaatgtggtacatttatacaatggagtactactcagcagaaaaaacaatggaatcttgaaattcacaggcaaatggatggaactagaagaaaccatccagagtgaggtaacccagtcacaaaaaaagacaaacatggtatgtactcattcatatatgaattttagacatagagcaaaggtttaccagcctacaatcctcttcaccaaagaaactaggaaataataaggactctaagggaaaaatgcatggacccctgattatgggaagaggaacgatttcctgagctaattgggagcatgagggtaggggagagggagctgccagaatgagaggagaagaggaggggagaggaggaattggagtagcagaaatgttgagttgggggaagaatagaggagagcaggatgagagataccgtatcagagggagccattataggtccgaggagagatctggcactagggagatttccagagatctacaaggatgacaggaactgacaatctaggcattggtggaaaggatagcctaaatgcccttcccctatgttgagattgaagactactttttatgtcatctagagccctcatccagtggctgatggaagcagagaaggacaaccacagatatgcactgaactgaactctggaacctagttgcatagagggaggaatgaagatgaaagggttctgtaacaggctggtgaaacccacagaaacagctggcctgaacaaggggaagcacattgaccccagattgctttctgggaggtcagcacaggactgatccagacccctgaacaagaatgtcaattaggaggcctctgcactctaggcggcccctgatagtggattagtatttttccctggtgtaagaagggactttgagagcccatcccatgtctccgtctggacacattggggagggccttggcctggcccaggatgatgtgttggactttggggagcagctgtcgagggccctacccagcctggggaatggtgggtgtatggggtggggggcagattggagctaatttgaactaataaaaaaattaataaatcatccccataggcccatggggaggggcactattaggaggcatggccttattggagtaggtgtggccttgttggagtaggtgtgtcatgtgtgcatgtgctttgaactcaaatccagcctagtggctcactgtcccttcctgctgtctatggatccagatttagaactcacaatctacctctccagcaccatgtctgcctgcattacatcatctttcctgcaatgaaaataatggactaaacctctgaactgtaaaccaatcccaattaaatgctttcctttgtaaaggttgctgtggttatgctgtctcttcacagtcacagaaaccttaactaaggcacatgtcaagtgttttaattagggttctggggatcaaaaatcaagtcctcatgattgaaaggcaagtgctttactgagtcatatcaacagatcattctttacatttcatccaatgaaattatttagtcatgaatagttttcattttgatctgtattttaattgtggctattgacttaaaaatggtagaaattttatgcagtagatttttaggtttcctagttaccttgcttgatattcaaaaaatgtgttctatatttgtgcattacgaacaacatgtagatagaagtcttcttataatagaaacagattgtttgacatttggttgttctttatttcaaaaaaaaagtggtacatggaaaaatgttaagcttaaaaaaatggcaagtgagtttaacaaaaagtttattgtgctcatgggtttgaccatgcttaagtattagacaaataaagcaagattgatgatggaaatatcaagaggttactttttcatctcactggtgattataaaaagactagttgtcacagcaatatctactggaaaaaataatagatataccgattctatttactacaggaatgaactacaagagccaaatacttctgaaagtaggggtcctatcaactctgtactatttaataatacaagagcaaataaattttgctaaggtcaacttccagacttgccaaagaaactagagttaatatgcaaataaataaataatactcagtacttcggttgaggttaacaaaatttatttagctggttgaaaagttttatttgaacatggtaactaaggtttccaaaacttaattgcaaatgtcaaaatggatgataataatatgaatgccagtgcagattaatatactccagatcttcctaattcattgaatagttacagcaaaaataaaataaacaaagaaatcaaatcaccaatccaaaccaaaccaaacaaaaagcaatggagaatgggctgtaaagatgtctgacagagcattctttcttcttttctttcatgataacacactgcactgattttatatagataggcatactttaaaaacaaagaccaaaatttatatgagccatatgtgagatttcattgggaaaagtaattttagtctatcaatcttttctgttgtctctgagaacacaattatccaacaggaatagcatcttacacctctaatgaatgtaaaatcttctatcatctgtgtttgaaaaaataaatatgtaagtgaaattagtgagaataacatctttgatttcactcaaaatacttggagttattacctattcaccatatgatctagaatatggctataccaccctgaacgtgtttggtatcctcactgtgaaaatgtctagtgagctagttcacaagttttacttcaaaaacttgtgtatgttttaaatgtatatacacctctgtttaaatgagtaacattttgagtgctcaatagcaatttacaagtcagcttatctcattgagtgttctccattgcataattatctttctaaaatcttcacctatcattaaagttgttcaaattaaaccctgggtttcatagattgggtatttatgaaacaggacttgactcatacaaataaacattaagcaatcattttgtgtgtataggggttgtgtgcatgacatagtacacttgtggaaagtcagaagacatcttgggggagtcagttcttacctttgatcaagtgggtgctggggactgaactctggtcattcactttggctgcctatgcctatattgacatctccatgcccccaaatatgcattttaaaaactgaaatgcttcatctgcttacaagaagatggaaactgagatttaagcactctggatatcatttgcatatattaatttcatacagatctaggttttcctgtttaatttagctaatataagttttaaaatgtatatatatatatatatatatatatacacacacattttatttgacatatatttgaccatatatatatatgttcatatccttcaaatatatatatacatatatttgacatatatttgaccatatatatatatggtcaaatccttcaaattttatgaatcaaacatgtaattcctattttcataggattaaagaattcaaggtctacaggatattttacccactagcaacaacaacaaactacctactaatctcttatgttgttgctggttttctttgatatttttaaaaattttgttttatttttggataatttcacgagtactatatttacctcatctcattactccccttctccttccaactcttcctttgcatgtcccttgaacttctcaaattcatgtcttcttaatctgtaataattattgttgcatatacatgcacatacaataaatgcaataaattaaactcagtgttgctaatgtgcatatgtgtttaggattaattgcttgtgattggatcatctatcatggagctgctttcaaaagtagaatgactctccctctctcagcatccgttaattgtgtgtagctaggccttgaagattcaccccatccatgtcagtgggccaatgggtaactcatttacccacatcgtagtgccttaccttgtctaccaccactcaccttgagataatgagctgacccttttttgaacaagtggcttaagcagaagaaaatatttgttagtaggaaagtgcataatggtcatttttagataacacctggttagaagcaaaataaatactggtggtgaaattctgtgctcctcagagaaatgtttggacagtatatgaatctaataaagaagattcatgagtagaccttgatggctttgtgttaatggcaaattcatcacttacttttcaaacaaacagacaaatgaattaaggcaagagatcattctaatgaaaaacaggaaacttgccatgccagaaatgtatgttttttaataaatttacccagtttataactaatggctaaaacttgaaaattttaaagattataagccaatgatctattcatttgctatcaacatgtttgttcattttgtatccaaagtggattttcttctgctgttaactattttaattgctattataagtttcaaagatcattgtaatgagccacaattatttgaaagtttaagcattcaactttcttaaagtccagcaagcacaaacacttctagtcacagttgtaatatgtaggtcaagaattggtactcttgttttgaaagtgataattaatcttgtcttttatctattgccaaagcaaaatgaaactccagttagtttcagctgttaagagataaacataatgttgtgaaaatctaagaaaggatgttatttctaaatgagaaaggtacatggcaacaccacaattaacaccatataaagaagtgtaaatatcatgtgtttcaactcataaattattatcagttgtacatatggatttaggaaccatccttgtctggcttgaatcaatagtttaactctatcagatgtatgacttagttacctgaaagtctgcagcagagtagaattttggtactatccaggcatctggattctctatatttatcaaatgtaaaagataaattaaaggtaatttggttttgaagcaacatttgtacggttgctccacaaatttcacagtgttataccacattttctttatccactgatctattgatgagcatctaggagggttcaatttccttcctaccatgacaggttgtgcaaatatctcagggtggagcttagatatacccagccagatgaggcacagtgagtttgtttcttaggtacgttttcagtcttgagaaatttctgtactgctttgaatggtggctttatcagtcactctttaccagcaactgaattgtacatatggatgtaaaaacaagattcatccagcttctgtcatgctggttttgctttaatcagacttaagtctttgctatctgaaagtatgctgcaaagtggagagttggtagctttggaagtatctctaaggcatctggctcttgaagtttatgtttagatacatatgatactccacagtgaataaactacatttggggggaatcttctggcataaagataattttgaatatggagaaaaaaaaggtagactaagaacaaaagccaaataacaaatccaggaagtatgtggatatgtgatactgaaaaaaaaaacatttttatggattactgatatcaatattgtttatcaagactttgtgtttgtaacttagaaaggaagtatcccaaattgaatactcctaaatcctccacaatatcattataacttctgttctttgtggtttttattattatttctttattttttgagaaaatattatacatctatacttgttttctttcaaatacatggtctactttttcattaactttattagatgcatatttgtatatacatatgcataaatatagcttgcttggtctgtatattaccacttttattcatgttttcatggctgagcatttagctttgggtaaccaattgttaatatagccaagtaatggcagagtcacacccacaaaatttcagcaataaatctgcctaaacatgagttgaacaagaacaacttctgttttttctctcggtttatgatcatgatgagttctcctagttgaaaaacatgtaactgtgtacatttatcactaaacacaggcagttacagcagcttcacctgtcttggcaggggaaagcagtgccctttctcccttatttaaaagagggtattactcaatgctgcacaatctgatgggattacaacaggatgtggtactcttggtcacccaacttattgctcacaactgcaatcttcacccagcttcttctcagacagcttgctatcatggaatcttgtgccaaggtttcttcagcctctgctgagccttccttacttgggagcaggttaaatcctgacaaaatgatttctccactttattttggtatgctcatgatctttgctttaatataggttgccacctctacatctctgagatatatgcttgaaaaacaacaatttaaaaggaggaaaactttatcttggcccagagtttaaatcctggtcacttggctactttgctctgggtgtaggatcaagcagaacaccatggccaggagcatctggggaaacaaagcagcccacattgtggtgatggggaaactgaggagctgtacaccatcaccttcctttttctgataggcctcaccacctaaacattccatcatttcccagtggtctgatcagccaggtccaagccttcaatgaatgtgatataggggacattctagaaataacacatgacatgccctctgtcctttccggggctttgggttcataaagtgacagaagcttttcttggggttggtttcctcaggagagaaacataggtgaaattaactgtctatgtttttagggctgaccatctggtattggataactgttggagcgatcttccctggggaagactatttatcctgctctccacattccttagatgttctttcctagggttgagatttcacctttccaagttagcatgtctattggtgtcatccttgttcaagtcatgtttttaggcagtcatgttggtgagatttcatggctgcatcttctgtcatttctaggagacacagtcacagactaaacagtttctatttatatatttaggtatatatatgtatacacagacacaaacacagacagacacacacacacacacacacacacacacacacannnnnnnnnnnnnnnnnnnnnnnnnnnnnnnnnnnnnnnnnnnnnnnnnnnnnnnnnnnnnnnnnnnnnnnatttagagggaggaaaaggaaggggaaatgttgtatttataatctcaaggaattaaaaacaggtccactctttagttctcttcacaagaagagcattcatatgtttaatatactaagtactgaaatatattacctatatttaggctagtaaggtgatgaaaaattatagttctaggaatttaaaaggttaatgtggaaagattgcttgtcctgggtgtttaaattcaggctgaacaactgaatgagacttcagctaagaaataaacaaagaaagaaaaagattttataactcagaaacaaatgttattttttctgaatatgtaaagacttgcagaatgctttggataacaagagaatatatgtaacactctctcaaaaacctagtatgttgtactgtaatctatataattatatatactatattatctgttatggaatagattaaaaattcaaaactaggtgtttttcaaaaacgacaagaaattaatttacagacactctttacctttcctcatctctaagcatttctacagatgttgaacattgtatattctattatggtgattgattctagccatctgaagaatgcttctctccatagatgtcaggacaattggtttttaaaaagctgttgttttgagtaatgatcatcaagggaaagaagctgacatttctaggataatcttagctttctgtaaagtgtacgattagcttgtggtggtggagggtaatgtatgataacagcaagtgcgtgaagtcattgaagcaaaatcttgcatataagatataacaagaaacttagagatcttttcaaagcactttttgtatttaaagaaaagaaagtttcccaaacggctaaagttctccaaacactgtgagggtcactgaaggggaatgtctctacccacttagataaatatgatctaattctaatatattctgttttcctttttatctaatcagaaacataccacagttcttattgtaggatgtcagacagagtgcaaatatttcaaaattagtgaggcttcttaagctggcatcaatttgggggcagttcatttcatgatgcaaaatgattttctctttcctctttctttgcggagtacacaactcagatgtttctgctttgaaagctcaatgttaatgatctctcccaatccatatgttggtactagtctaccaacctgagactattgaccatattgttgcaatgaaggtagatatggcattgacaagaactttatacttgcaaatcctaaaataaattagctttttaaaaattggtgattttaattgttcatttgtacccatattatatggttttcactataaaacaagggataattagtcataatcatcatgtacagaatctcattggagcttaaaatctttcttattatggaaagcaacagcacttaggtacctaaacttaacgtgcattcaatcttttttaaaaaataagaactttacacatgaggcattaattttgttatgatttttatggacaaagaaattagataacttccacagagcctcttctccattgaatcaaaaaagaagaacctgtacacctagattcagtgattcctgagtttatgttctcaaattcttcaacactgtttatttgcataaaatgtaaataatgagataaaatcaaactagtcataaacagcagaaagttgtaggtaaaggctgtaaaaaagatgcgctgatcaataaaacgtacgttaaaataaaacgtgcaacatagaagagaaaatgcaaaataagcattaaaataataaaaatatggcaactcataacaaaagcattaaaattttatttgagtatgatcacaaaaagaaatagactgtattacaacaataaaacttattgaaaaaaaacttttgtaaagtaggaatatgaggtgtaagtcttgagacactggtctaattcaggaagagagactgtcacagttatcaggattttctgtcgtggaatgtattcttcaaatatatatccagtgcttcctgtggcatataatacatgcactggggactctggagtgaaaaagagaccaggagccctacactcatttgtgtttcattgacagagtcagataataagcacatttgttaagtaaaataaagtatctgtgctatacacggaagggaaattaaacagaagacagaagctcttggagattgcagttctaactcagggaacatctacacaaatagactgtacttcatgagggaactggagaagtcaagatattaaaaagaatatattcacagtataaggttggatgccatttccctaagccaggaacctagctagatgtctccacagagagcacagaggccaaagcaaggaagctgcagaagctgtccaggattcctgcagctgctgtagtaagaagtgtgacttaaaacaatgaaaatgaatcttctcacagttcttggagagagaattctgcaatgaagctgttgggtccctgaagacgctgacatttttatctgctggccacacagctgttttgtttatgtctgttgcccttttatgctcctctatgtcctgttctccaatctcccctgcttgtttcctccagagtacagggttgctatattccaagagaaaccaatcccctcatgatcttaaaataattatggacttaagggaggctatttttgaaagcatactataggggaaaatttgactaatcacagagattgaatgagaagatgggtgaatgagaatattggatactataggaacatacattaacttttactatttttttcttgtaagctaatgccatcaattaatttatataatctgcccagcacttctaaacattttctttatgttatgtgtttgagtgtgttgccctcctgtaagtacatgaactatgagagtacaggatccacagtgcacatccatcagatcccttgcaattggagtgacagattgctgtgaacggctatgtggctactggggaccaaacccaagaatcctgaagaacaagcaagtactcttaaacatggagccatgtctctagccctgtgatcaacacttctaaagactatctcttcatgaggaaagaccaacgtgggaagaccagaggagcaatataactagtttgaagttctgtacaacaacctagggagatgatgcatactaaattgcattctacaaattgtctgagggaaatgtgatattttaaagattgtggtcatgcttgaaacatgtggcatcactttaggaaatttctaagagcatgggtctctgggaacacatttttaatacggggagtagacagatcagagaagttttgggttttcttgcctatgtcaaaagcaaactcttacagttaaccctgtaaatatatttagactcaaaccatgtcttatttactaggctaaactgtgtgccccttcccatacctataatttagaatctcaagataattgtaccaatagtgatatattaaattatgatattgaggaatggatatgggttgaccctcagtgtcttaagtcatttttgttaaggttaaaacactattagagctggaaaaatactgtagatctggcttcttcagcattctctattaatgatattcatgatattttcttttgtctgtgtataaatccaacatgtattgaaaataaatcatagagaatgaatcttaatgattgtctcatataaatttaaatataccattgattaaatgtgaaaaaaaaaacacagagcgaaaggttcatagttattctcctctccatttttgtgaatttctctgcctctcatctctcctgcttcaggatgactatgaatgaaaagcactgtccagtggacctttggagatcttccatcttaggagaattctgcttacctcctacatttgttgcatgccttattctaaaatctcctaacccactattttcaagtttatttcctcatttagtgtagcctatttgcattagttggtgaagcaattacaatgtttggcgggagagcagtgcgccacagaacagctctcactcttgacatcaattataactttggaaggttctcaaagcaaccctcacttttgataatttgctagcactcataacattcactgaaagctattttacttgtcataatgacatgacagggaaaagatacaaattaataactgccacagaacagagctcatagagtgtaacccaggagagatcaaatatagaactttcatcttttctttgtggggttagagtatgttactgtcctggtatggtgtatggcagtagatgtgccatattggcagtcacaggagatcactgtgctctgtctcagttgatactggggtcctgttttataaccctgattgacagtatatatccttagtcttggtctctatgttgactgatgttgggtcactccaagtcttcagcttaaattgcattgtttgtcttcctggtatatacaccttcactctaaataacaccctaagtttgtgctttgtgaaccaaagttcatagctaaacaatgagttttaccagacataaatttccagtgaccctgatattactgtcccaatcttgagaataatataatttctgcaggcaaggctggattgattttcttgggtattgtgtgtgtgtgtgtgtgtgtgtgtgtgtgtgtgtgtgtgtgtgtgtggtgcaggtgcacacgcatgtgtatatgcatgatgtatgtctgtacttgggtcagagctcaacaatatggctaatttcatgggaaccctcctctatattttgaggctagactaacatgtaagtcacctatccctcccatccattttatgcgggttcttgaaatttaaactcaggtcctccagaaccaggctccctgaacatgggtgtcagttcagagaccagagcagtctgtggggtctctgccagtggaaacagtatttatccctagttcatggactttgagaacccatttctcatggaggtatactctctcagcctagatacatgggggaaggtctagtccctgtcttaaatgtgtcagactttaagatcaccttgggaggcctcaccctccctgagggctgtatggggggttggtgagcggcattggaggacaggagggtgagggaattgagattggtatgtaaaataagattgttttaatttaaataaaaaaacaaagtaaaataaaattaaaaagataaactcaggtcctcttgctagaagaggaaatcttccccctcttcctactattgtatagtagtttcttgagaatattcttgaaggacaaaatgcgaagaaaatcgttaaagtgtgtgatgactgtaaataagtaataacacattccacagtttgcatccacacagtacagaccaacatgcaatttcccctcaggagtagtaacccagttttaaattatgtgttaagaattctaataccatcctgattcttaatcaattatggatgaccctctttggctctccaatgattttagaatcttctttgcatccttagttcttatttaaagattatcatccttgggtataatcttgctttattatgctagaatttagttggccttttaaatcagaacttcatgttctgatgtcctgaaaaacttaattgtattatttttctggcaaatctatttaaattatttattttcttcttctggaattgtaattattcagaaaatgaatgtggattgaccatctaatcctatgttttcccactgcagtcaaaatcatcatagttttaatgcaagcatagtttctttctgttcagaacattatttttataacatcctggtttgcttgaccatctcaataattaaggatattagtaacaatattctttattttttctagtgccttcattacattttaaggttttacattttgttgatattagcttcttatgttcttatgacatatgcaacttgctttccttagttgggcatttttacattgcattaatatttagtagctagtcatgaaaatatatgatttttaaagatctgtatgaattcagagtatttggtattttctggatatccctacaaggacagagaggaaacttgctgttgttgtaggacaaacaacctgtctctcttaccttctctcactgcaagcttttgttttatgatatccgatataaccagctcaattgtccatacactttcatatctaattttagttgattaacactccaaaggcttttttctgtaatatgtttctgtgatgttcatttttcttcatgattttcctcttgttttttaatcacaacaaaattacatgttttacccaagttaaaggattattgaaaatattgaaaagtcaggagttagcataaagagtaaaagcttaaaatactacccaggagacaaatacagatgtgtgtgaggtaaagggcagacctgtgtgaggttagggatgaaattacaagatctctgtgatgatctgtgcagagaattctagtacaagctggattacatatacagtatctgtgtatgtaatataaaacaaacaatggatgagaaatccaaaataaaataaaagtatgccctcagaagaaaacttgtaaaataccaaataaaaaattatgtaggggatcttggaaaaattaagttaaatagcttcacttcccagcaagatgtaaattacgtgtgacagtgcatgcttctcatcccagcacagggaagatgaaggcagggagatcatgaattcagggttatcttcagttacatagaaagcttgggaccaacttaatgcatgaaaacctgtctccaaagaaagaaaggaagaaaggaagaaaggaagaaaaggaaaggaaagcttataaccaacaaatgtatgttattgctaatgacttaggagttcattaaagtcaatgtatttatttctcttctcaatgtgctcttaaaatggatattcatatctgatattaattaaatgtagatttaatctgaacattgtccaattgctttaatattgctaggaatttcaatggaatttgtttatgggagaattcctccaatagttcataattcaatgtgcagatgtaaatgaattgtcccattactatttggaatagaatggaaaagttttagctatcctaaactttggagttcaatttcttatcctattattttagttataatcattaaatatgtgattacaaacatactattagattatcatttaataaaacatctgtttcacatccaaaacagcagatgtgggccctaagtgtgagtctgtcctcaatggcaggtgtcccacactaggtgcagggcctatgagatgcatctgagtgactagagaaagtgttgtcttgttcggtcaaccatttacacaagtctccttaataggtacagtcttagaaagacactgcattaataaaaaagatatttctgtttgaatgaaacatataattatgatatgttccttcatggaaggatgtgtattaatatactttacacaaaaagagaagatcaattagtattgaagatttggccatgtttaaaaccaagtctgtagtgtgggaatcaagattcccagtacatgttaaaggaattttatttggagagataacacttacacaagaggcaagtggctcctcccagtctgttttccatgacctgcaagcagcaagagctagcactggcctcccagagccagcctaaatcctcccctcctgtaggcacccatgaccacgcccaaacaggggaggtcagcaccacaggtgcatagttacagctctacgttaagttgaagcttgttggcttcagggcaatgtttggggctagtgtgcatgcctgaactccatgcagtcttctccaaccttgttataagcaggccacctggtataaaagacatggccttgtccacttgctttcatgactgcaattggcaagaagacatgaaagctactcgagatgtttgtactttccagtgtcttctcttgtctttgttcctggtatttttcttgaagctgctcagggccaacaggcagtgcagagggattggattctctgatacactgtaacttccttttgcaactatattgctgactatgcgtacatgcacagggtgggagaggggtgggagtgggggtggggggaggttttaaattggtaactgacaaagttatatataaaatagtaagactttgatgttctggttttctttctctgaagtctatagcggcaaagtaagatcctgcagacagactgaccttcccaagggtaacttttattaggaactaaatgagtctcacattccacagatgtttttccggcctttgtaaatgcaggtggctccagaagcaagcttcctggaaatagatattcctttgtggactcacatatgtaactcctgtcaaaaaaaacaaaacaaaacaaaaaaacaaacaaaaaaacaaaaaaagtgtattttaaaagattattgccttttcaaaatataaaatgtcattttaaattgtatcaaataaatatattctagaactaataaccagatgcaatatatttatgtaaatatacatatatgtgtaatagtaaacatgtctgcatacaattattcataagaaatcaaagcttgttcttattttgtgaagagaaaaaggacaacaaatctgtgattgtgatcttaaaatgaaaccatcactttggaaaactgagaccaaaactgatcagagactaagatttctctgaactctgggggatattttcatgcccccaagtttgctattcaagcagtatcttccttggatttctcctgacttaggacttctggacaccaccaagtgctctctgaggggtcagttgcagaaggctgacttgcctttttttttcctcttttatctgttggtgtctgttaaaactcagaccagccaaccatggtggccataatcactcaatgttggcattgatgttcctgactagaatattggaaatctcctgtaatcttcaattggttcctgaagaaatacagggaattcagaaggaagattctcttattaaggtgtgggtatttatgcatatgtaggtatagatgtagctgtataaatgtagtaagtttctatagaggaggtttccctatagctttttgttgttgtttgtttgtttgcaagacagggtttctcttgtgtaacaactcttgctatcctactcgtttttgtagactaggctggcggcaaactcacaatggtacacctgcatctgccttctgagtcctgggattaaaggcatgtgccaccactgtctgtctccctatgtttttttaaacggtctttagtgtttgttctctctccacatacttcctactcagctaaattgtctttccttcccccacctcatttaatccattttgttgcattaatcccaattcctcatccatagtgcatgcacttcaagtcttcgcccctttccctgacattctcccacccacaggccctcagaagtttcttaacttccatgaatactccgatttaaacacactttctaaaggttcacatttttgacatataaaaatgaaagtcgttatggtgttaattgtttgtctgttttcagtcctggcatttggtgttggataaccagttgctatcctcttccctgggaagattgtttcttatgatctcagtatttcatagtagcttgagttctctatgtactcttgaggcatggctatttttgtactcattcagctcattgtagtcagactttgtttggagtgccaaatcctaaataatgacactaagacttcttattatgtatgaaatcttagctttatcttaagctagtttttaactagctctgaaaacttaaattaacctgtttattttaatctacattctgccatgtggatagttcctgtgcttagtactgtgcatcccaattcctctgtgtctggctagcaaaatctgcctctttttttcctggagttcctatctctacctagaagtcttgcctatcttctctggcctagctgttgggcatgcagatctttattaaaccaatctgaaggtgccttggcagagacacatcttcacagggtaaaagaaagattaccccacaacagcccatgtttagacaatcatgttgatgaaatgtctgacattcctgggagacacaacctaacttcaaattcaagtatctaggaaattacacacacacacacacacacacacacacacacacacacagcgagagagagagagagagagagagagagagagagagagagaattttaaaagagactgcatttgaaaaagataaaagatcaaaaagagcaagagcaagtaagtgtatatgggaggattttcaggaaggaaagggacagaagaaataatgtaattaagaactatagtcctcaaaacagcttcgtattggcacaaaaaatagactggtagacaaatggaatagaattgaaaacctgatattaacccacatgcctctgaacacctgatttttaacaaacaacccaaatttatactatggaacaaagagaacatcttcaacaaattgtgctggcataactggctgcagacatgtagaagactacagatagacccaagcctatcaccttgcacaaaacttaagtaaaaatggatcaaagatctcaacataaatccagctatactgaacctattagaggacaaagtgggaaatacccttgaattaattggaacaggagaccgattcctgaacattacaccagtagcacagacactgaggttaccaactgataaattggacctcctgaaactgagaagcttctgtaaagcaaaggagacagtcagcaagacaaaatggcagccaacagactgggaaaagatattcaccaacctcacatctgacagagcgctgatctccaaaatatcaaaaaactcaagaagctagtcccccaaacaccaaacaccccaattaaaaagtggggtacagaactaaatagacaattctcaatagaggaatctaaaatggctgaaagacacataacaaagtgttcaacatccttagccatcagggaaatgcaaatcaaaacaactctgaaaaaccatcttactcctgtcagaatggccaaaatcaaaaacgccaaccgttcatgttggagaggatgtggagaaaggggaacacttctctactgcaggtagaagtgccaacttgtacagccactttggaaatcagtatggtaactcctgattaccataaaaaaatgggactcagtctaccacaagatccagcaattccactcttaggcatatacccaaacgaagcacattcatacaaaaggacatatgttcaacgatgttcatagcagcactattggtaatacccagaaactggaagcagcctagatgcccctcaaccaatgaatggatatagaaaatgtggtacatttacacaatggagtactactcagtggnnnnnnnnnnnnnnnnnnnnnnnnnnnnnnnnnnnnnnnnnnnnnaggaaaatggatggatctagaagaaaccattctgagcaaggtaacccagtcgcaaaaagacaaacacgatatgtactcactcatatgtggattttagacatagagtaaggattaccagcctacaatccacaatgccaaagaagctaataaatatggaggtccctaagaaagacatacatggtcccctgaagaaggggagaggttcaagatatgctgagcaaattgggagcatgggaagaggggggagggagctaggagaatgagaaggggagaagaagatggatgccaaggacatgagggagcacaaaatatgagtcaggggaagaatacatgataacaagattggagatatcataatagagggagacatttttggtttacaggcactagggaaatgtctgaagatctacaaagatgacgccagctaactatctcaggaacggaggagaggctaccttaaatgccctcccctgattattagattgatgactgacttatatgccttcatccagcagctggtggaagtagaagcagacacccataactaatcactgatctgaactggaacccagatgcagataaggaccagtgagaatcacagaggtccagaccaggctgggctggtgaaacacacagaaacagctgacctgaacatctgggaattcttgctccacagtctgatagctggaataccagcatgggactgatccaaactctaggaacatgggtttctgtgaggaacctcagaaatctatgggacctcctgtagaagcccagtatttatccctagcataggtgtggactttgggagcccattccagatagaggaatactccctgagccaagacatacaggggtgggcctaggcccgatcccaaaggatatgaaagactttgatgacaccctatggaaggcctgacctttcagggggagcagaaacgatatgtgacagttagttgggggggggtaggggaggacgagtgggagaagggaaatgggattgtcatgtaaaacaatcctgtttctaattcaaataaaaaaagttggaagaaaaactaaagattacatgcttgacctagatttttagttaaggcctaattggaaacaccaaaaaaaaaaaaagaaataatgtaataatattataatttcaaaaaataaaataaagaattaaaaagtaaaatattttaaggtgcagttaacatagaaattttatatttgcattcccattgagattgcataaaaaatactccctagcagaggaatgtgtgaggtcttaggtgtgttgctaaacagtggaaggaaaataatgaattaaaatcttataaaaataatagtagtaggggtagtgataatttgttcaatacactgctttctcagagacattataaacaaaattaacgtattatttataatagaatgtcaaagaaaaccatatgaacttttttctttcttagtaaaaatatagtcacatatttatttgtatacacctttattaagaaaaatattaaactctcaattcaggtttctaatacccaagcctaaagagagatattctaaatttgacttttctaccttattctttttctcagatttgtaaaagagttccttttacagtctcttatcagatgttgagcacagcattgcaccctgcatgctgatgtcagtctgaccccaatgtactgattgaacaaatggccaggataatcaaaacttctcagaaccttgccaaaattgcaagttcatatttgagacaaaaattattaatgactagccagtctcctctgtgtttggggagagtaattatccataattagctcacaggtctatcctgaacttctttgagactgttataaccctgtgagtgtgcatgcagatcaagacaagacagattgctttcttgaacactctgagctggggctgtcctcccatcctcccagtgagtttcagatattttagttgacttgtacttttgaaaggtcattctaaatgggctttccaaattagggtgattgtcatatagtgtgatctaaatattaagaatgttctgaaacttaatccatttgtaaatgtgctattgtcataaagcaatatcattatttcagtgcctaccctgattgtacattatcaacatttaggaaaatgtgtttgcatgtatgaatgtgtttcctaatttgatagaatgttagagagtatatgtgataaatattaaaatgaaaattgaatcattttaatgaacttgcccaaatgaagttccttcatacatttgtgtatatctacatatctatgatatgaatatagatatcgacatcttaagtgccattcttaaaataatataaattttcaacaaagttaccaatattagagatattttatgcaaatatctactatagaccttcagatgatgaaaccatggccccaccattataggtggcaactgagtgtacaattttacagaaagaaaaattttcagaagaaaataatcagaagttgagtgatacctgtgatggaagttttgtcatgggaaccctcctttgtctagctataagtgcaaacattttcttgcaatatattcatttactttcaaggctctgtataggcattctctttctagttaattttgcttatctactgtgttttatagtattaatatttttagtttccccaagctctttgggactcattgaattcaaactaaatttttctcagcttaggttccatgataatatcctgtttggaaagcgcaaagtggactgcaaatactgggtataaacaggagtggaagaaaatcacccttattcagcagaatactattttaggatgtaggatttgggaaaatgttgagtccagtagaaattacatggagaattaaaatgacaataagtgcatataattaaccaagctggaatgtgttgagacaatcagggccaagtgctcttctaattattcagttaatggacctgttcatgccaaactggagagtgacactgagtctggtggcctgttttgcagaagtatgttcttatatttgcagtgtaaatccaaatgggagttaactgttaatctaaaagcatctaataatgtcccaggtttccagtttctcctgtgaagttaatacttttgctgtttaatgcctggattgggatgagtagaatagtggataacacaattcttctttacagggatggtttgcacacagaagactcagaacaaggaattatcacctctaatggcatatgtatctttaatcattaaatagaatccctgggtggtgacttggttcaccaggtcaagacactttctaccaactctacctacaatcagagtacaattcccaggacccacatggtgggaggaagagctgcctcttacaagttggcctctgattttcacatacacacacatacacacacacacacacacacacacacacacactgtaagaataatcaggaagaaaaatacaagtgtgggtggggggaatgtgtgtaagcatttgcaaggagaatgagggatggaggtaatcatttttcactatatataaaattcttaaaaatgaataaaactttaaaaaattgcatatcttcattttacctaaaggagtcttaaacagatggtgcccattattattatttgttactaatccaccctcacatttcatggtaatgttcactccataactttctacctctggaaatgagacgtgaagatagcttattagtcattcactcagatgtttccaaatatgtgtggactggatttctagtccacttgctgaatgttccacattttatttttatgccttaatattcttaactaactggaattcttcaagccacttagatgtttcctcttaaaaacaatttacatgaattgtgaaactctccactttcctgtagtcactaattctccataacattggagatatagagatattttattcaagccctgcagaacaaacaaatgtgtgtagcgtacggacccctgcagggtgttttgagaaacataaggtagtgtgttttcatttctccctgttattgcacagaccctggtctgacagacgcaaagatgagtggtccattctttgctcacaattctcccatcctccagcaaagggatcttcatcttccctgcaatctgtttctctagcttccactacagacctaagatgccatctccatattgctaaaataagcttgccacccttaaaacataaacccttcattactgaattatagtctgacccctactcctaatgtgagtgaataacccaacctgtgactaaagtagcaggttgattcattagtaggtaagtgactctattcatatacaagaggtttctagtccagattcaaacatcagtttcaaacattattcttcttgtaattgactttaactgtgaagtacttaaaaatatatagagtgatcacagaaaataataaggaaatggtttcttattattcaataagattgctggatccgacatttaaaaagctattgataagccggaaagtgttgggaaataaggttaccaagctggtaagggtttcaagataaattatggtaatagtggggttttgaagatttttttctctgaaacagaacagtttagtctttttttcccatctattttacaacttttattgttcaaagtgagtggttaaatgatagcatgtagttttattttatttgaacttaaaatataattttctcatttcttccctttcctgcctccatcaccttccatgtacccaccagcgtctctctttcatattcatggctgcttcttttctattttcttttatttagatgttgatacatctaaaaatattaatactaatatgtatgtaatttctggaccatttggtattaaattgtggtgatatattgtttatgatttattaaagccactggatatcaaattagcaaagcagccatactaattagctgtagaagtcagctagtggtggcactcacctttaatcccaggactcatgagagatatttaagacagaaacaggatctcagacctggcattctttctccagccgcattgaggatagtaaggcattcattttctagccacactgaggagaagcagcagtatgagagctagtggagacagaatcaagcttttcagcctcaggaagaagtaagagctagtgacttggctactttgcttttctgatatccagcttgaaccttgaaatgcaatatcagtctctgtgtcttttatttattcatgttacattaaataaccaattgggatgcacttccctggggaaaggggttatttctccccttctcagtattccttagttgtctgtaggtctttgcttagggttggaggctcactgatatttcctcttttgatgtttgtgtgtccattggtgtcctccttgttcatgttgtatctgggaagccatgtttttgaaatttcatcactgtagctttcgtggcatttctaggagatgcagtatcacagaagacatctcactctcacagtttttccacccgcctcatctatgatgtttccagagctgttaagtatacgaattttgttatagaagtagcatttatgactggtaaccaccacatgaccatttgttctctgcatttgatcagttttggttttctgtaatggccttcatttgttgcaaagagaggatactttgttgaggaatgagatttaagcttatctgcaggtataagaagagatatttagagtgttgttacagattgttactgtgtttaggcaaagtggttgctgcagactgtcctccaaattcctgatctcattaatctgcatttgttggttttgtttccagtacaaagcatgatctacttattgttgaggctttaagtccaaggctttaaaaatgttgctggttaccaccaggctctgatgctaccattattgtgacaagctcattgttgttatagttcataagtatcacagcagggtaggattgttggaggcttccattctttcaattctgaaatgtgtggtgcctttagcaatagggctatgactttcacctctgtgagacaacaaagggaaagacaaatagctgataatattttggaaatcctttgggctaatctaacaaacaactcaaaagagggcttcatgagcctggaattgggggttttgttagatagactgtggctcttggaggaaatcagtgccagcacagggaggaaaatttcgtttgaattataaatctgcatgcaaactcagatacttaaatttattatatataatttaagtaaatggatagcatgattccttatgacttaagacatcctttgtttattttatcctccttctcacttgtgttgatctcccgccagattcaaattaacccccggttgctggaatttcttttctgccaggtcatgctaccaccttccagccccaaataaacacacaaagactttatattaattattaaactgcttgctgatagctaggtcttcttattggctagctctctcttaattattaacccataactgcaagtctatgtatttctacatggtcttatcttaccagagaacacctggcatgtcctatccttctggtctttacctggcatcctccaagggcctctatgcctacctttcatataattctcctagtcctctagtcccacctatcttcctgtttctactgaccaaacagtgatttattcatcaactactaagagaaatatatatatacagaaaaacatctcccattatcccccaaccctgttttgtctattcaaatcacttttatattgctattgtcctttctgctgcttcctttgcttgcatccctgcccatggtcccttggtcacttcctggcttctccagtcactgaatgttctgtagttacatgtaaagagctggagttaggagccacagatgaaggagaacatgtgactataacatgggattttaaaactgaagacaagtgctattcagatacaataacacctatgaataaatgagaatttaattccctggttgttggactaacagtccttgacattttcaggatgctgttctgagtctatagaagaaaataccagctattttgattcactctgaaaagctgaactaaaaatcagtttttctttaacatgaagaaaaatcttagatgatacaaaactatacaataaaaaataatgatggcaataaataagagacaaggccagtattgcattgacttctcctggagagacacagcgggttgtgttctcaggagaaacaacccagaggccagagaatgggtaatgcctcttaactacttagtaagtctgtatctgttgatcagccccatgaagctccagctttttcacatactgctgagatccagggccccatggtggatgctgctgtcatgctgcagttaaacaaaggaggacaaagtcatcatggctccttgtctttggtaaagttggtgggtactgaggcagcaactgttctgaatgtgcactgggcctgtaagtaccatagcattaatcaacaatgaaggtaaatttatggcagaatagagaaacttagggcttattggctatgcatttttccatccatccaagtccctcttattacaaggttgatcttcagggtcagtatgccttatgaatcattcctcagtcatcaggctgttttgtgtatgtgctcctcaatgcctatgacattctcagtgtgctctgaccccgactcaaaccctccactaaaatgtctgcatgtcctctctgatttagtcctttattttggcaggaagcctggccatcacctgggcagccatcttgttgaagtcactttgcacattggagtttcatcacgtggtaaattggtggttggtgtccataagtaatagcagaaaggtttattaagccagtacaaatttctgtaacgcctagtctttcatactaaaatcagaatttccaagtatgttttatttatttagatgtattttttgtttgtttgtttgttttcaagacagtgtttctccaggtagctttggagcctgtcctggaacttaatctctagaacaggttggagttgaactcacagagatctacctgtctctgtctcaaaagcactgagatttaaggtatgtaccaccactgcctggctttcaaatattttttaaatatagtttttaaacatgaaaaatggagctcaacaaaaactaattttaagatttaaaaaatttggatacaaatgtaaaagaacagtggtgatattaacctattaaaactggaattgtgaaaacaaataaaaaatacagcttttggatatgtaaggctttgaaaaatatttagtcttaaaacaatcccttcaaaattcacatttctctcctaaacataataacataaagagtccaaaccaataatcttaaatgtatttgtcaaaagtgaaacttatatgtcataatgcttttccccccaatttgatatttatgatggagtctctcactgccctggagctcagcaagtggacaaggctgactagttagcaccaggatatggctgattctgataccttggtacaaaaccatactcatccatttttatatgggttcaggaatgctactcaatggaattatgtccttagccacaactaaataatatttaagttgagataatcaataatggtaaaaggtatttaagaattataaatggtgtaacattttctcactcagtatctagttagctcaccactatttcctgtagttagaaatccaggacctcacaggtcagagcaagtagcaggatagagaaacttcatattctcctatgtccttcatcttcaagtactctggcagctcagatgattgctttgaaatgaaaatttgacacatatttgccataagttggcattaacagggaggaatccacattttctttacatgtgcaatattgctctcagcttgcatcaagtttcagggtcccttccatctttgaatgtgctgccttgtgtctggatgcctttccagcttggctattgcctcttcattcttagagatccaactaaggtgccattcgaaaacccaaacaaacaaaaccatagttgaagtgtttggagtaatagattggtggttaatagcactttctgcacagtcatgaggacaagaaatcagaacacagcacccaaataataactatgtcaggtattcaaatgtctgaaactctagttttaacagattgtaaacccctttctggcataaacacatacaccacacttgtactagacacaaatatttgtgcatataattatataaacacacacatacacaaacaaacaaatacataatctaaaattatgtagatgaggagcaggcagatagctcagatgtcttatgaatggatgaagatatgagtttgatatctagaatccatgttttaaagaaaggcttagtgttgtggttcttgcctataatcttagggcagggaaagaagagacattgatcaactcattgaataatgaggactcagttgtgtctcattgatcaaccagcttcacctaattggtgagttccaggtcagagaaagaccctgtctgaatgacaaggtagacagcacatgaagagtgagaccctgagggtgatccttggtctccctagacacattcaaatctaaacacacacacacacacagagagacagagacagagacagatacagatacaaatacagagagacagagacagatagacacacacagtgatagacagactgatacacaaacagaatcaggtagagagacagatgcacacagagagggtgacagagaggcaggcaggcagacagaagcaaacagaaagacagacagagaaacagagacagacaaacacacattaagagagagaaagacagatagcaagattgacacacagacaggcagacagacacacaaaagggtgtgcgtgtgtgcacatgcatgtgtacatacacacacacacacacagagacatatgcacacacactctagattgcacagctgcatttcttttctgtcattacttcaattgtttatcaacttgttttatatcccactggacaatacttcctatgatagagacagtaagttctatgatacagacaataatgtctgtgataatatccagaaactgtagagctcaacacataacaggctctcacaatgagtagtgaatatatcaggcaaggaaaaaaaggtgcaatatggtgctttccttgatgggaaataatagagattgaaatgcactccagaaataatggaagcctattaacaacaacaaacaaaacaaaacactgtgatttcaatactgctttcattttattttcctccatctcctactagtgacattcttctgaccttattggtctacagcattatacaactttataaagaggattttaaatgtcagccacccctgacttcctagaactgtattcactaaaagaggcagtgggaaaatacgacaggtggatatgtgttggggattagagtacactggggactgaaaggaactaccaatctcattagctgtcttctgagttgccgaattctacaagggtccccaaggtgaaaggctaataattaattcaatttactatctattctgtgggaagctccaaaggttaagattatagcggacctgagagggcaatcttttatactgtttaaattgctgtttaaatttgaattagattctaatagtgacagtttgaaaccgacacagtttaattcatttatcatgtccccaaacctgtgtagctgagctggttttaaagcatgccttaaataagcagccgtgcagagcacacacatgtctacttgtattttttacttggagtttaaatatgaataacagtgtctactattgctaactttcaggtattaactttgtctacatggccttacccatgccaaatgaggcaaagtacattgttatacattttcatgctgcccaaatcccagaattctggaggtaggagtgaggaacagcattacgattcaccaggatttaccaatgtctgtgttcactgaatcttgcctacatctctgccaggtggctatctacaattacaggtaaacaatcttgaggcaacacttctgagttaacttgattgtctaatgatgaaactgtctttccaagtctgtgacacaagtatttgcttcatttcctccatctatgctccatcctgacagaagccctctacagtgctctacaccaggttgttcattcaggggagatctgggccttgccccagtagtcagttaccataggcatctgtcatttctctatgttgatgagtgtcactctgaatctgccattacccaacagcaagcatcatgcttcttcctcatacttccctccatcagtgtccactgcttttagaccatcacagacactgtggtatgaccagggaggtctgtagcaagtatttatgtcttcttacatcttctacattgtccagctttcctttttgggagagaattgtttgtttgttttgtttatttcccttgtttcaatttctcgggactttgttataggttagtaaaatctttaaaaatggtaactgaggatataagaacaaaatgtggtacttcctgttatccctcacttttattttagtgatgccaagactatgggaagattttcaaacagtatcaataacactagaagtttctaaacagagatctaatagttaacaaatgattcaaagttacaactggatgattgagtgaggccatcaaatataggtgcacacacattcacacacacacacacacacacacacacacacacacactcacacacacgtgtgtgtgagtgtgtgtgtgtgtgtgtgtgtgtgtgtgtgtgtgtgtgtgtgtgtgtgagtgagcatatgtgagaaatatatacttaacttcatataattcatagaattcctgtatgaagaagtagaaattatttcacaattctaaatcatggtgatatattcttatataaaagaaacaaaaagggaaaagaagttttctattggtgaaacaatttacttggagagagactcattgttcagtggagtctcccttttgttggaagaatcagcagagtctttccttaaatttataagctgagtgagccaagtttcagaatagaatcattctgagatttcaaatacctttccaagcatctgaccaacaaagaatgaactttttgtctaaactgtggattacagaataacacagaaagcatatgcagtgggccaaagagaagatgccttaatgtgtaccaaaaggaatgatggcatcataggtatctaatactattagaatttatccatctaactgtaaaacttagctggaatttactcaagagagcgcttagcaggcaatgtgttttattttgatgaatgctttcctttggtcagatggcccagcctttgggagcagggaattacagaaagtcagtcttggtcctatacaacaacactgaaaggagactaaaagtgtaaaagtaaagcattcagagagctttccattttctggtgtcttctataacttctttctttgaagactcaaagttcttactatacaggtctttcacttgtttggttagcattaccccacgatattttatgttctttgcagctattgtgaagggtgatgtttccctgatttccttttcagaccatttatcacctgtatacagaaaggctactatttttttagttaatcttgtatcctgccacattgctgaagttgtttataagctgtaggagttccctggtggagttttttgggacatttatgtaaactaacatatcatctgcaaatagtgaaagttttacttcttccattccaatttgcatccccttggtgtcttttttctgtcttattgctctagctccaacttcaagaacaatattgaagacatatggagagagtggacagccctgttcctgattttagagaaatcatttttctctaaatattgagtttctttccatttagtctgatgctgactgctgttttactgtattttgcttttattatgttcagttatgttcctgttatccatgatctctccaagatctttatgacaagtggtgttggattttgtcaaaggccatttcagtatctagtgagatggtcatgtggttttacttttgcagtttgtttaaatggtggattacattgatggatttttgtatgttaaaccattgctgcatccctgagaagaagcctgcttgaccatgttggatcatttttctgatgtgttcttgcagaagttatcagaaagttctcccatgcttgtggatacataggatcaatctagtaaaaatggcaatcttccaaaagcaatgtacagattcaatgcatttcccaataaaatcccaacacaatgcttcatagaccttgaaagaacttccagaggcatcaccatccattacttgaggctctaatatagagttatagtcttgaaaacagcttggttttggcataaaaatacacaggtagaccagtgaacaaccctgatattaacctacacacctaaaaacacctgatttttgacaaagaagctaaaattataccatgaaaaaaaaaaagaaagcatctccaacaaatggtgctggcataactggatgctcacatgtagaactcttcagatagatccatgtctatagccatgcacaaaaatttaagtccaaatggatcaaagatctcaaataaatccagcctcactgaacctcttagaagagaaagtggatgtacccttcaatcaatttgtacgagagagcacttcctgaacataacaccagtagcacagacactgggaacctgaattaataaataggaccttctgaaactgagaagtgtctgtaagacaatggacacagtcaacaagacaaaacagcagccaaaataatgggaaaagatattcaccagccctacatcggacagaaggctgatctctaaaatttccaaagaactaaagaatctagtctgcaaaacaccaaataatacaattaaaaagtgggtacagaaccaaatagagaattctcaatagaggagtataaaatgactgatagacacttacaaaagtgttcaacctccttagccattggggaaatgcaaataaaaacaactctgagataccatctggctcctgtcagaatggttaaaatcaaaaacaccaaggacagtttatgctggagaggatgtggataaaggggaacactcctctactgctgatgggattgccaacttgtacagccactttggaaatcagtatggagtctctacaggaaaataggaatcagtttaccccaagatccggcaattccactcttaggcatatacccaaaagaagcacattgatacaacaaggacatctgttcaactatgttcatagcatcattatttgtaatagctagaacctggaagcaagctagatgcccctcaactgaagaatggatagagaaaatgtggtacatttatacaatggagtactactcagcagaaaacaaacaaacaaacaaacaatggaatcttgaaatttgcaggcaaatggatggaactagaagaaaccatcctgagcaaggtaacacagtcacaaaatgacaaacatggtatgtactcactcatatatggatgttagatatagagcaaaggatcaccagcctaccagccaccctgccagagaagctaggaaacaaggaggacactaagagagacatacatattccctgcagaaggggaaaggggcaacacctcctgagcaaatttggagcatgtgggaggggagagagagctaggagaatgagaagggtgagtctatcttcccccactgcagaggccattgctttcagttgagaatcctcttgagcctttcaaccctcttcacgtgctgcttctgaaaggagggatactgtgaaggagggatactgtgatgtgtgatttcagggccatctcactggattcccttgttctcagaattgttgagtcccagctttgctagctctctaacaaatttacataggtctgattaaaaacaataacaacaaattcaaactaaaacaaaaacaaatcacattcttttttctagttaactttatctattctaaatagaaggtttgatctactgattacaaattttcttatagaagagaagaaattatctctacaaagtattaatcttaaatcttttgattagtgtgtgaatataatttttcatcctatcttccaaatatacttttattaatgtaatgtctttacataagtcataataagatatttgataattaaacgttatttttaaagtctcattatttacaaagactaatggattgcacataagaattattttttccaaaataaatcaactttatatgttttggtaacatttaatttaattttaactttctttttgaatgagtactacggtctcctattacatacccctaagaataaaccaatattttcattaataaagatgatatgtcaaattattatctctgtgttgttgattcaagtaaagattagcttcatccggtatgatcgattcaaggaaataaaggctatatgctattttagttaaaaaggttaaatgaaatgtcagtctgttattaggaaacttcagtacttggttgattttaaatgctccaatacagtaaataacacttggaatgaactttaagaatggcagcattttccacaacgtaaattaaatctttgtagcattctcaaaagttcagtaatgacatcattctcaagcccctagacaggatagtgatggggagataatcctccttttagttaatgactttaaaaagacaattcgtcatctaaataccatgcacattattgtttcttatattggatttaaatattcatttttattttaattgtttgaaggttttgtctgcatgtgtgtgctccacatgtatgcagtccacgtgaaagccaggagagggcattccatttccaagaactgaagtgatagatgttttgtgagccatcaagttgttgctgggaaccagacgctggtcctctgaaggagagcaagtgctcttaacttctttaacatacccgcactcccatgtagactatgttctaacattttgagaatgacatgcactttttcacttatgaattttgtaattttttgtcaatacaattacacatttaaattacttattttgttgtgttagttataatgataaaactattttaaatacatacaaattcagagaaaactgatttgagtgatgaataaggtaataataactatgacatagtgttaacatagcttcaaattgtttttgtaattgtttcaaagataaatttgggaagtttcacattgtaaatgctctaaaataatttagacttgtctaattcattgaaaatttgttaattcttttttttttttttttttggtttttcaagacagggtttctctgtgtagctttggagcctatcctggaactatctctggagaccaggctggcctcgaactcacagagatctgcctgcctctgcctgtgccaccaatgccgggctgaaaatttgttaattctaagacctattcatattatctactatttattcttacttattttttttttactttggttgtattttatctatatatagcatctctcttactcactcagtctttgtgcttcttcttcatcctcctgaattttggctgcattgatccataatgatggagggagtagaagcacaaaacagcttcaggacagttgtaggtatgatggagacatagatttcagtgaatcagctcaactttattcctcagtataggaaatatgaaggattggggagccaggggacaaaccctaattttcattacacggcatgctcctatcacaaggcttagtacgtagcagtagggttccataacagagctcttaccacaaatcttctaggaggaatctgtgccaagcaagggtcaagctaaagataaatcagtcatccggtttacagacagctttcagacaaagtcagtcttctgagtacaggggcgttgcccagataagggcaggtaagaagcaggaaatttcactggggatggagggagtgtccatgttgccaaacatttaggaaaagctgccaggccatgagagactgccagcaatgccctacagtaaaccttacttgaaaaatagaagcaaagatatgaagaaagtaatgcaaagtgactaacttcttgtttctgtcttcctcagagaattactgtttcttagccattatattaatctattcctgtgtatatctgtacacaggtgtacatgtcaggctgtacgtgtgaatgtcagaggaaaacttacagacatcatgtggcttctgcagatgaaactcaagtcaccagaaagcaccttcatctactgagccatctctccagcctataataagttttctggaatgaaccaaataaagaattttgtgttgtgtctacttactctctaaaccaattttaacaggtattattttgtcaaataattgttcacttttattcactgaaaagatagtaaccagtatcgcccatcattttaaatgtcaatgtattttagatacattagctaggagcagacatcattgataaacattcacgtgtgtatgccatgctttaatgtataacatgtaagtgtcaaaattgttatctcaagctcaaaagatgagcctaattaattagattaggaatcctttgttgtccatatcctcatctaaaccattgtttcatctttcttaaaccatatcatttgagccctagaatttgcctgggtgaggattttcattgatgtatacttaagaaccagtgtctaaaatgggtgccatcattgtgacagtaaagagacagggaattacttatttgaattgggctcatagaaatgtagaatttattgacattttaataagcctcttatgcttagaagtgtgacaggtgcatgcacactttgttccaaaggtgcacaaatgaaagttatattatacaatgattggtttcgtaagacagaagagcagctagatataatataaggagtctgtcattactgacttttacatttcgaagctatactacttgctgatataagagacagttggtagagtcatgccagatggtttggttcagctagaagactggccagcaagccacagggctcttcctacttctacctccatagcacgccagtgcattcggtctttatgtggatactaaagacaaaaatccagtccctgtgcttgtacagcaagtgctttactctccgaagcacatttctagcctcaagatggagattttaaaacatccctttattacaatacatcgagtttttggcacctgagcaatcttttggcatatttacacacagagtcacccagcagtcacaccttcatcagccactcagagctttttggtttctgttgtctaaaattgatatgaaaatattttcacaagttttctttaatttgtgccatttctttaatttgtaccatttgtgaagtgatgacaaatctcatttgggaacgcctcaatggctcaaaggttcatttctttgccttgtttcgtcccccaccagagacagattttttgacatatgtttggcactcagtatattttttttccatatggggtcttgtgtatatggttctgcaattggaaaattgccctctgtagcccaggtggtattgtacaaaatgattttctcagtattgatttaagcagttgatggttgcattgggtacagaaagtcattgaattgtatcaaagagctttctgtaagaagcaattggttaagccttagctaaacgacatcttcagaaggcatctccagcaataaccttaaattcaatgctaagctttcttctgcattgcagcacatgccctatcatttagctgaaacattttgaaagaaaacaaaggagggtttcccatcagtggttgctaagcattaaattcacaaagctgttttatttttcccatgacatagacatttttcttttcagccagtttgtgaaattggtggatagaatgggattcagcttcccaaagacagcatagcactctatgcatgagttcttactttgggtcatatttagaacattgacttgctacannnnnnnnnnnnnnnnnnnnnnnnnnnnnnnnnnnnnnnnnnnnnnaagcatgctttggctttctagcttagaatttcttacatcaggacatttgaagcttgttattgtgctttattcaaaggaaagctggtgaacgtttgtacataaatatatgtgatagctatgtgtacatggtaaaactaaccttattgtcccttgtacattcacatcatcctgtaaatcccctgtccatcttctcattactttccaatgaccattatgttgtcttttccctttctattgcatctacccagttcaatcttactttacttactccttgtaatcattctccagtctcttgcttcactaaaatttatcacaatggtggaaatctatgtgcatttaaatcaatagcaaatctcaagtgcctagatttgtgtctggtctatgaagacagttggtaagtgatgttgaaatagtgaataaatttatctctatgtgaaaaattcattaaaacacaaatctgtatttgcttgtacgttatttccatgaagaaataacagttaaaaggtgttgtgactctcaattaatttaattgacttaaattaatcataggtgaaaaacaaattataatgtgtttccaatggaaaactaagttcaaggaagtttccaaactgtcttcaaaggaacaccaggaaaaagttcatggtggaggcatccaagtagagcttggaggagagaacccatgctgccagctggcttcaatagattcctgagcataattggttactctatggggattcatgaagctcacagtcttccagcttctctctacagtcttcttcctgtgatcagttcatatacaatagtcatttcaattctgaagtttctctcatttctcacatacacatattaaataaatggcgtagtttgtgcacacactcttgaatgtttaagcattataatatgttctaataggaacatccttatattagttcaatttgcaaagtcttagtactcttgagctaagttacagttgtctcaaagagccccacctttctataattacctgtatatggaatgacctgcaacatccaaatgataatgtatttatataaatatgtcacaagtttctaagcagttaccttgtacactttaagaactacccttttctgggataagctcccatcacaaagaacagcattattggccagcacacactatgaatgcctgtgataagacagagaagaacacccagaaatagaactaaagcagactcagttgatggaatctgtgttggcttctatgatctcaattgaaatgaacatgagtcttgtagctctatcagaaaaggcaatgaaagccaacaaagaaactgtaaagaaaagggggagaatcccttccatctgtcttccaccttgtgctcttaccaaagcatctctcctaagcagagatagggttccactgtctatacgtgtattccaacgttcaaggcagtaaaatggtgtaagaacagaaagaaaagccagagacataaagatgtctgtggcctcataaacaagctgtagtcttgggcaccatttaggtatcaaatctagataataaaccttaacaattctgccatggaccatgaacccaattgtatgttcttgacactgacagactgaaaaagtatttttccttaatgcaaaagtgaaaacagaagcttagcaggatgatgaagaagccccattttaccagggcttatattaacaaacacatagaaaacaaaacagcaacatgcgagagagatgaagttttaaaatgaagtagggagccagggatgtacagaatggattgaagtttaatattcaaaaggaaaaatcttagtagaaatgagaagatagtagaaattgagcagtctaatcctttatttggattttaggtagaaacccaaatcactttagactgtaaataaatcttccccaggatacagatataatattttattagcatatggcatactgttacccagtaacaggggcttagtttaccttgaagaaagaaattcctttgtaaatgagactgccaaagcacaaaattctagtaagactgtgtccaagggcaaaaaagaagaacaaaacaaaaacaataacaaaataaataaacaaaatatttaaggtttcaaagatgaggtgtggggttgagtattggggactgctctgtgattctcttgctttatcttccagcacttctatttctctcttgctttccagaaaggctgtattctaagaatggtgtcacaaacatcctggaaacaagtaaatgatatatgctatgaaattccttctaataattgtgtctttcggtcctatgtggtaacacagacaacttgatactctcatgtctcactaatttttgacatttaaacaaactttcttagtattattttacaatctagaaaacaattttccaatatcatttatacctatcttacatatttgttttaatttatatttgttgctggtaccattgtatttgattcatctctgatgaacttttgtataaatgacagagaaataagtttgtttctatatgtgaggagtgttaaatgttttaatgacacaaaatttgtaaatatagctgaatatatgatttattattagaaattaaatcatggatatacaaatgagaagcaaatttgtaaattcttgcttttaatgcatattagacaagaatacttctttctagttcatgtcaaattatttttttagaatctatagctaattggaaaataagcaagggtcacaacttatgcttagcacattatttcatgtctgtgctcagaatctaatataattcaaactattttcgactgtattacacataacaaattattgcacatattgatttacgatagtacctcctatgtgtacttagtacaggacatttcaacaaaatgccataactctcacaacttaaaaagtccttaactttgtattagcatgcatttatgggcaactttcaaataaaactgaagatcaatatagaataaggaaatgatggttttcttcttagaggtgttttgcttagttccaaaacaatgcactcagattctgaacaaaaacctgtgagtttgagcccacagtcatgacatataatgatgcaaagtgtgagcttacagcctcatggagacagaagaaacagccaagagaaagatgcacttaaaatgcacggcttatgtttgactctgtgacaaccaagtgacaagaacagatccaaatacaatcctgacttagagtgtcaattaggagaatggcagaggcccttccaacattataaattactctgattgccagtaacaacagctctcactaacagtcattttgcatgatgatgctctggacaaacgacagatgatgaaggataaacctagtatctataaagcaatggggtggttctctagacacatgacagagcatgatcagacaagctactaccactctaaatacacctgtgtacagtgattacaggcatatgcctctgcttcattagacatagaaatgagagcaaacatcctcaagatactgagaaacacattcataacatgctcattgcatgttacaaaaacacagtgctatatcttgatcatgttacacatgtaactatgatatattactattatgtttgttacaagattggttgattatttgtggtatactgggagtgtaactcctatattctgttagttttagaatttcagaggaacatgtccaacctctgttttattttctgtcacaagtggctagtgatcctatttatgactgaatttgtatcagactttgtgttaacactaaaattcattccctgtacagtcttgtcactacttgaagcatgattcattatttagtatcaaatatataaaacaacaaaacatctttaaaattatcttatgtctaagtaaatctctgtatcatcttcccatctttggttttttattttcatatttaaatatggcacaaattaaggtttagggagattttgatagctccatattattttaattcatgaaatttggttatgaagcatcttaaagctttttgaagaaataagaactcaggacagctaagttacttctttctgttattagactggaacatttgaaaacctcataaaggatcaagatctattaaatcaattaaaatgtcctggaaaatagttaagttcataagtatttactcttctgcttttcctcactatttagtactcaatatcaagtgcaaaaaatggaaactacaataactgtgttggcacaaaggaatttaattagagaattgcttatggttctgaggtgctggcaagggcactcatgaagggagatgtgggcaagcagactacagctggcttatgcttttctctgtgcttccagccttgactcccacaagaggtgctgccactggagaacctgacccaagtcagatgtcaagaccagcacacacaggcacttacaaagacacaatcagtcaataaccagggatggcagtgtatggaaaatttctagtgtcaacaaaaacaatgtgtgttctctaatttccattctttagtgtttcaaaacaaacaagcaagcaatgaagttttgtgattcctctcaattgtgaagttagaaaggggggagggagtgtgggagggtagataagttattttaattttcaattcgtatcctaatggagattttttttaacaaaacacaaagcaaggcctcacataagtaccaacataaaggtttgcttcttttttgttagatttatttcttttcatttcatgtgtttaggtgctttccctgcatgtatgtttttgtgtcatatgtgagcagttcctatggaactagaatgatgcaatggatctttttggcactggggttacaggtgtctttgagtcactatgtgtgcattgggaaacaaaccaggtgctctgcaagagtaattaatgttgttaactgctgggccatctctatagcctcaactttgaaattttgagaattaaattcaatattctaattcattaaggaactagagcatagcccttgtttaataacaattttcctgtagttttggcctttttatttgccctctgtcacattttcctccatacagcacatggttcttgtcatcagttttaaaatgtcacaggcactagccacacaattgtattttagcagatgaggaaatcataaaatcaaccaaagcacagatgatctttgagggagctattcaaaatctcaagaagtcctgagtctttcaaatgtgatagaagatagactttaagtctctgattgcctgggagcattttggatgttctttgttagatcacaaaatgctctgaaaacatatcttatagagagcacagcagtgatgggctaattcagagtcctttccttccctttcttatgatattcatgtcttagtcaaaggaacactgttcagcacagactcccatgtgagagtttggctgttacaaccaggcatatccctggttccttgtaatgatataaaaggaaaatgccactaaatcctgtgttgtggcctacagatttcagctgccatgttaagtaacagctagactttactgtctacccaagacagcctccattttattctattccagttctgagacaaaggaagtcttggattactcagaaacataaactctacacaagcttgatactagactgaatcggttataagtctgccttagggaacaggaaggtagactgcctaccacacagctcataatcatgtcctcctacacatatgtacacttgcacttatctaaagaaacacaagtggaaatgagacctcttcccaaaattctataaatgacttcaaatgttatcattgtctctttatattttccctcaaatttccatccccccaaacccctcctattaaatgaagaaaatttagagtggtctcaaattcacaatgccctttaaacaccactctctggataccctgcctcctaactgttaaggacgcttactaagccattaaatgctgaccagtcgttcactagctatttacagaatatttctaaagcctttatctaatccaaatgacttacttctatggtatgagatggaatgaattatccaactgataatgaaaatataaaatgatcctttaaataatacagaaggaggcagctacagatacctgtgtagggcaaacaccaccaccaccaccaccaacaacataccaaccaaccaaccaaacagacaaacaaacaaacagaaaccaaacaaaatctctgttgcagagaaattattctttagcaatgaactgaagagacaattttaaaaccaatcttttagaaatgacagactgagggaaccaaaactcacttgtatatccaatgaagagtaggagaggcctcgaacagtgactacaggaaggtaaaagtcaaataaggcaggaagctgtagcagaatccattcataacagaaggccctcttctgaacaccttggacacacagttttcctatgtctcatctagtatagttgcatctctagtaaatatgctttagtatgtacatagatgtcatttttaaaggaaggattttgtactaggtcctgcagttttatataacagattcttttacgtggatttatgcatggggagtcaaagtttggactctaaagtgataaacacagggcatgcacttgctgtatggagtggctcctgagtctggctgtgcataaatgtgcttctgtacaaacactggtgattctgtttgctttccagtttatgtctcctcctgttcctgtctccatccattttattagccactggaaataattttatacataattcaagcttgaattattatctattttctatgagtttatcagtggtacaatcaaaaactgaagaaacaaagaaccttctataaagaaatgtggtcttgtgtcttatattcttctatatctatctatctatcatctatcaatatcaatcatctaaaatgtatctttatgcatgtttatatttgttcacagaaagaaataagcagctacagaaaagcaatttccaaaaatgcaaagactaggattacttatataacagttgaaataaattttatatattaattaatattagcttaaacagatttccatttttactctattgatacaccatcacccagttacctgtaacttcaaaatgatgcaacatgcacaaaacattaaatataatttcaaaataatgttaaaaataaaagagatatgctgggaataatggccaggcctttcttcaagtctgtagtattaaaattcattttaagtgcatgaacaattagataaccaagggaaagcactacgatagaatccatggcaccctcagcttttgttgttagaaaattttaacctctgtgtctcttttgatggtggtaaaggactgttattttttctacacatgatcatatgatggttctctttttccatggggacaatgtgcagactagttctgctctaaaatagaaagcatcctagaagaacataactcagtgctgtagcaataacaattttcaggcttttttatatttcacacacactttcttatcagttgtttactttcattttttggagtcaatgtattgctgtgtagcccacctggaccatgtcagtttttggccccagtctccccagtgctggtattatacagtgtaccaccacactacgctacttttctcttaaatgaaattcagatctaaataaatgactttgtcaaagggtctttaaatagtatttttcatgattttaatatatatcatctttattttccctttttattaatcaagatttgttcattggttagcaagggcccatccatgaacatgaaacacatacacacacacacacaaaatgcatgcatatgtttgtacacacatattgtatagtaacagagttatacactaagacatccatgaacttgaaaataattttgtgtatgagagtttgtatcatttcttttaattatattcccataatcttctcctgtgtaacttttcctgaaagcccatcaacaaatgacttctcatctgagataaggtaccaatgacaggaaaaagaaatgattcaactcaattctggcttagtgaaccaatgggtaactggggttacaggaaaaagatttagggcctgcttataggaacatgagtaactcaaaggtagctatgtcaccagcccatattactgactcattaaagctgtatcactggatggtctcccaattttccatgaagacagtatcctctcctcaggcaaccattactgcagaaagacttagcttgttaattcctgatgcttccagactaatgtaagtttcattaacatatttagtcttctctttatgaaggaaattttctatttgaaagaaatagctacataacaggttctttctagtattatataaagcccccaggcttcaattatttatagatgtggttcaatgagtctcctacagttgcaacttaggttcactctgcccatcaggcaagttcatctaaaacactgtgctatcatgcattctccttttacctgaaatagagttggacagaacaatagccaaacctccagtgctccccagggaacctctgctgttctcatgggactcatcactatcattactgtcctaggggctgggcctagatggccggcctactgtgataagaccctttaggatgattaggaactatgtaggaagagggtaggttgttggcatgcaaatctggaattatcttctttgagataatactaatcctgacttgcctgataattgtgccttgattttctctttatagtccctcttaatgggatgaatattttgggtgggggagatggaggctcaacttcaacaagtaacacatactgttagcagtgtgattatttctttcttgaaattaaatctcagctcttacctcaaatctgagagacaatgtattccaatttgcattgttgttattgttttttcaagctcttgttgtgtgacccagggctgtaatgaactattttcttcccccttttctatatttctgtgattgtaaaataagtttccacatagttattaatcatccttaagcattttcatttccttgtccctgagatgttttccctggctccctctgcatgtacccacttgcttcttatctttttctctgatttattcccaagaaaaattttctccatatgacttacctaagactcatttatgcaggtacccccttctgtgtattccaattgcagcaacttgtgcacccttgaaccatagcactagcattatgagtaattgcttattttcttctcagtctctaccaacccagaacatttgttccagggacctaaagatctctctgcccttgtagtgcctcagagtttctgcttatgccaatgataataaaatgtctgatgaataattaatgagtaggggaggtcttctccactcaaaagtatcttttggtactgattattatagaagacaaaacagatgtttccttttttttctaatcctggtaacatctttcacataccaacaaagccctttattgccatggtagagagcatcaagggacatcgattgaatctctatgtttgatggtagtatataagtctggatatctgccagaattaagagtgatataatttcttgtcaaaattgtgactcttctgagagagttaggacctgtggttcaagtgtgattgaaataaaccaggattctttgaggtcactttctattcacaactactgtggttataatggcctgactaggtcccatcctgaataagatcaatgtttatgtcgtttttgttatattagttacatcattttctaaaacaggtctgattagtggagatgcagcaggtgatttaatagtaatttctgttgtgtttccttttccacctcaacatccatctgaaatatttgaaagaggagcagaagcttactccccatcattctgctgtagtatcagtttgccagtaaatgctgctttaatggggtttcttctggagtcttgctgttatttttttaatgccagacaatattagttcatagtgtctacttctacaagtcactgtccatgttttggtatttagagaattcctgtattttgcagtcatgattctgttttagcatctttttaagagagctgaacagagattttcctgtttcagattttcctgaactgaaatttagtcttgcttaattgtcactaatgcactgccaaaaggtccttagagtgcacagagccacaaactaatacttccatatgtctgaataaaggttcttcaagtactccttgcccttcaatcacctgtctttccacattcaacattcctggcccagttttgaataaagtcagtgaaaatgcagacacttggcattgactttaccctttgcccaaattcaatgcttaaagaaacatgtctaataatattctgatgaactttccttttcattgacatttaaaatctgctagaccctacactatccccagcaggagctctgccactgggactgaaatctaatttggctgtcacaaaaatagagaataaatctggagatagggaaaatggagatctttaattctctagttagcaataatattgtctacaagtagcaatcatcctttctcaggcataggtaatagagccctagagggaatccatgtaatccttgaagaaaataaacttaagtagtccatgatagtgccaggtaactcagggtgtccttagaggaccagcagaggacaatgtgacaacatgagcaacagtgaaagtagtctccattcttctaagaaagccagagaaggtaaatctcctgtctttggcggagaggaaatctcaatgacatcaccatcagtatgacattgggctccttatactagaggcaaaaacaaaatcaagaattgaccagtgcagtggtaatatgaggaaatcatgactgatctggtggggagaaggggagcatgcatcaggacactctaaagggttgtcacctgccgtgcatgcaggctgctgagacctgaaagactaaaactggtcagttaccaacttttgaaactaaaggatattttgagaaaagtaataacatttctatgactttatgcatggatagcttttgaataataaggcctaacaataattgtgactaacttctttgatttttatgtaggtattatagatacaaatctataattaattaaagttttataacttctcaccatcatgacagactgaaaaataatatttaaagcattttgaaagttaatacaaaaataacttttccatttagtgaatatgcataagaagttctaatacttttatgaaatccccaatgcttttagttttttctctctgtggtcagaatagaaagtttgagtgagaaatgactatctcatttatcacatttttttctcttatgagcaattatatatttctgagaatattagtagcacttcattaatatatgatgaaatgaaaacaattaaatgagatggaattaaaagttggaacaaaagttcagttaaacaatatttctcaataggtttacactttgtataatagctttggtaagggcagatcactcaaatatgggaaagaatgttcactcctaataaatctaagtctcatcatatagcaacaatggtagatgtaactaagacacatttttcgagatacaataaaaaataagcctaatagagactgtgtattggaaatctgcattacagaggaacaggtttagagaaagtttcatgaagcaatcaggcagcatgaagacagaacagtaataggcacacgaaatagaatgagagcctttaggatacaaaaaaagaatatatgcaagaagaaattattaaaagattcctggaagaccaataaaatagtgttggtttaattacaatgaatctaaatatgatctttaaaaagataaagacagatatgagaagttcttctatgctagaggaaggcacacacagagtagaaaactatcagtctttagacacatcagggaagggagtttctcttcatttttttcaaattcctaaatctcagaaatagtgggacaaacaggtgagctatggagctttatttatttattttgtgatacattctgtgtaaccaaatattatcttgcatttctgattctcctgcctttatggccaaagtgctgaaattataggccaggtccatccaggttttgttttctttgtttgtttgcaactcaacaataaaataacagttgcaagtattttcctggggttattagtactataagtttattttaaatagatcatttggcagtaaagatggtaatgaaaaaaagaagttaataaatatcccttgtaagatatgataagattgtggcagcattattgctgtaggtgtgtttgtatgtgctagagggatacagaaatgttactgggtaccatcttagaaaaggagggtaatagactaatagaaatgttcttacctaaataaattactggtgttatccgaaactgagtaagtattgcaaggagagactcaaaaacagtggagagttatgatttagacatgaattagtattatttatcctaacccaaggttgtaattgttcactctgattgaaaatgagaaattgatattcattctacaaccttttgaaaaatctccatctcttttcaatcctaccaatgtgcaatgtgccacatggctacatgaggccaattataatctgtgactttatagtcatgcatacaatgctgtatttctgtctttaaaattcatttaggttttttgaacatttataggtacttccagaagtcaagaaatcctaaaattttgtaaataaaaattagctaatttttctcaaagatatggaaaaaataattcaatagtaagtgattatttgcactgacttctgatttgtacacttagttttacattgaaggaagtgattttggaagtttcatatctaagtcaggacctatagactccatctcatatgtcttgctgtgaaccaccactttgtgtcttcagtaaagatacaaacctttaaacaactttagaatttccctatcaatagtgaaacccttgtgaaaatccaaggagggaaagaagaaaggcacaaaagactcaatgaaaggatcagaatactaaatctggttcaacaaaattagacgttaagtgctttgaacactggagtaaatccaaataagaagggaatgcattgctggatgctcagaagtgtttggagaggatacagagagagatgccgccaacatggatctagaaactgttctcttcatttcatagggacttgctcaggaatttttcttttgggggagaatcaacataatatcacattaaaaacattagtcacattttatacacccatttgtgggtaaaatatagagaaattactctcattcatgtagacatttatagctaaaaccaaaacgtgctcagttactaaagaatcacagtttagagttgcagagcttaaatttgcattataattttcaataagagtggatttttgcataggaatagactttcaatcagtagctttttattttattttcatatatttgcttgagaaatagcataataactaagatcttaaaattcctatgaataacaacctaagttcacgtgctgtagtggtatagtaatgaacacatccatgacaacaaagcgaagaattctagtattggtaataaacttaccacaatgagtctgctgcatttagagaaagtacatccaagggggaaggagtccattgttaccagagcacaaaacacttgaaaaaagagacatgatttgcatttttaccttacaaatctgcaggcttgtgcacttttcctttttaaataaaatgtgtcaggtagctggtcagaaattggaagaactctaatcttatgctttttaaaatctctctattgcattgttaatagacacactccatcctcctgccactttaaagacacacccttttctctattttgtttttatgtaacagtggggattttgtgggcatttcaagctctattttaatatctgatggatattagggatggtttcttttagaagaatgttctgggttcaccaggttactagtttagtacttaagaaagagaacagaacctctcaagatccatctatctactcatttgaaggatcaatttccctttgtgtattaaagctcacctcattagcatattcctctcttcaccatctgcttctgacacctcatctagagtagcctgtgtcacagtcatatttaggtgtgttcattaaaatggcatgaggatggtgtgtgtgtctaacaataatgcttccatgaggctatttacaaaatctacttagatgatatatattaagaggtaaaaactttcatgcattcttctcaggaaacttttccctcaataaatagataaaacataaggcaaacaaagatatcaaatgaatatttagcagaatttttgggtggcctgctcttcaaaaatctgttcatacacttcaacttctaaatgggtcattaggtctcaaattctatcttaatgagcaaataagggataaagtaaaggcctcaagaaagaacagaactggtatacttaagacatgacatgaaaccttcagggtttggatcattttgctatgcacagggaaaatcatagtgggccttgagaccatcttcatgtgctgatatttggctgcttttgtatccactggtgagacagatattggtgagtggccacagcaggtagacagaagcagccacacagagcacttactagtgtcacagctcccatgcagagctgaagctcaggggccttgtctctacaagtgttataggtcttgtataggtcaaagaagtaaggatgtattagtgtttccagcagttggctctgaagcttctgggaagacacagatatcaggattccttagcctatgaccggagccaatttacattctgaatctgagttatctgagatacctggtcctaaaaggattggcacccttctggaagtcttccatctaccaggaatgtttcccttctgtggttcttacagccatccttcctttttattctcagctctctgtccttaacatcctctatctccttgctcctgtcttggctgctatcttgaagttcagttgctcaacttcctctgtcaatcatccacctactgtaccactttggcagctcaacttactgactgctcagctgtcattgataagctcactatcactccactgtctctgcagaatttttgagttagcagcagctcatctcacactgctacagcaggcaagaaaagaccaccatataaaagactttattattgtcaaaattatcattgttactattgttattttagtctaatgtggaaacaccaggaaaggtagcacaattaatgtctcacaactgattctccaaattagctgaacagtgtgcttacctagccagtaaaatggtgtttcgaccaatgacaagaaactactatgcaaacaaaagtatgaggaatcacagttctgtctttttcgtagtcctctgggaagtccctctgcttggccaccagggcaagggcctagccctatgggggcataggtaaatgtgtttttagggttctctggagtgtagggcagttttggataacaaaatgccttggaaaaattatttcaaacatccctggctgaggctgaggattcaggaattgcagttgtaattcttgtgtagctttctcaggttttagtagaatggtcaaaatggccagtgctgcaggaagggaagttcttattcttgactgacaatctttggttgatagcagcaggacaataagaaagagtttataatcaccaagtaagaagtcaaattgccccatcctgcatcatatgttctcatttacaggaaaatgaacataaaaaagaatgcttgtaaataatttaaaaaaaaccttttcattaaaacttatagggattttaacacctgccagtgtcctaaggagagatgaatctgtgtcacctgtctcaatgttaatgtctcacagtctcagaagcatgacgaaggaattgaaactgtctttaaagggtctggcttttatgaattctacatttcattaatattttggaacatactctaacagcatctcagaataaacaccttccataatttgtgcaaatagagaacatttagaataactctcatttgtttatgaatcatgttcacatactattccagaaggacctaatagagcccaatgattaattttttctatgctaatttaaagtcttggcgcttaaatgcttatgagagcatgatctaataagccaaaaagttacttttgatatgttttccctttggccattcataatttttcaaatggttgcttttgtttctattcatgtctaatttgattcactatagacaggtgtgaaacactcaaccatccactggcttccacctttttcttttacctttcccaatttccctctcttatttctctgcattgtttgtgagctttcctttaaagtattgtgagaaaattgataaatgagtggaatttatgaagcatatgtgcaattatgtcaaaaataacataaagagaactctgccccaggtcactagacttgggacaggaagaagttcatccaagagcctttggtgcctggcagtcaagcaccattataattctttgaaacagtatcctgaccagcacccatgatggactaagaggacattggaagataggcgctattatggtgtgcaaatgcatggagtagtatggaagagagagaaacccagaatggtttttgaggaggtgaaagcagtgaggagtgggctgacatgggtggcataattgccatccagggccatggtgttatctggacctggactgcagccagggcctatgtctgtgttcatggccctaatgcaattatagtctgttttgatgtccttgactcctaataccacccatgaccaagaagaaagggctgcatagatttgtccttgccctatcacagcatacaacagnnnnnnnnnnnnnnnnnnnnnnnnnnatcatctctacgaaatgcaaaatatagggaaagtgggcaggtccctcacatgctgaaacattcaagagagatggtcttatacctcacctgggctgcacaatagagccaatcctgttgatggaggtgtgggtgagccaattctgaagttattttaatgggaaatatagccccattactcagctatcatgtgtcagtatgagtgggggagagatatcttacctgctacccatcaatgcttgttgaaggtgggaaagctagccttgaggccaaaagattgggaaagctgttccttccattcattagctgcagcacttgggagagtgctccctaccctacagcatgcctaggcaaaacagtatagcaggacctgaagtgtgagtatggaagaacagactcaaagggcatgaatgcaggagaaatggccctgccgtttgctcatccctgtaaaaaaagaactagctagggcaatgcaggagtggtcaccctagacattaagacaaaggagagttggcggctaaccaactttgcatctacccagaaccaggcttttgtgttggcccactccaacatccactccatctataatttgctggaggacatgaatggaccagttctgcagacccaaagctgcagatcaccacagcacagggaaacagcaggaaaaccaagaggagttccaatgagaccttagcattgataatgtagaagaaaccagaggccttgaatcagaccaatgactcttttgcaatgaacacttgctagcaaagataaataaaataaaagggtttactacatgactcactgtgtcacactacaacttccatgatgagactgattttttccttctctcttatttttcttccttcctcttaaattttattttagtttacttttgggaggaagttgcaaggataaagggcagatatgaagggacaggtaaatgaataggatagagaagcatcatgtgaaagacacaaaggataaataaaaaggatttttaagaaaacataagaatttagtcgattgggttcaggtagtaatgggtttgttgtgcgagcatgaggaactcagttaaatccacagactccatgtgaaggtgcaattatgggggtgagtgtttgtaaactcagcactgggaggacaaagtgtatccttgggacacacttgccaaccaatctcacatagttggtgagatctagctaatgagggtccttgccttcaaaggcaaaggagactgctctgaagagtgccagctgaggtcattttctggcctttactagcatgttcacacatatgtattatactggtttgaatgagaatggccctcagaggctcatatgttcaaatacttggtcccaagctggtgaaactatttgggaaagattaggaggtatggccttattggagtagatgtgtccctgggagtgggctatgaagtttaaaagactcaagtctagctttctctctgcctccaacttgtagctcaagatgtgagcttctagcccatcttggatactgtctcatcaactgctttgcagctagactggtattgtgggaaaactatcaatataaatatttcatttttaataaatatacttttatcttccaggttcccaaaagtctttaacacatgtaaattgttcatttttattcaatttaatattaaaggaggcacctgtttgtaagaaagaaggagtgtcagctcaagtttggactatggccaaatttcacaagcgacaaatttgtgagcagcaaatttagcagcagaaagcacaaactagaggagacataactgccacatgtttagtttgaatgctcagtagctgtattggctaaagatatggaaactaggagaaaatgaggatatgctctgaataaaaagtaggatagtgtgggaacaaatgagttaactgcagacaaatatttgacaatagatagtttatgagttgaaataatattttaaaaatataagtaatgactgatcatggctaatgctttggtagtcaggacatggttctgtttaaggtgaaaaagccacatataattgagagctcatgcttgtaaggcaacaagaacattatcagacattcaagcaagtccataaaccatgaaacaaaatatccttaagattaaatagacttgaaacactagaatgcaccaagtgatgaaaataattaaactggagcaattgagatgtaaagacaaaggtgaatgctcttcctgagggcagtgtagcaagcattcattcccagagtcaaggatgcatagcagcctctgtcttgaaaaagaaagagctggatgccatgccttcacccagggctgcttagcaaccatcctaagcagggcagtgcttaagttaatctccctggtaagcatttgtagctattaatttaattagcagaggcagtgtagcatgaatcatctctacgaaatgcaaaatattaatgaggattttgaaattctaacctcagatacacatgtgggaatctattccctagttatatagtgtgcttggggaaatatactaaatataattttacagtaacacaggaaacctccttttataatcaggtgctatgtaatttcttgaggaattcacaacacaaatgtcctctctaatctcattgcatacaaatgtatggtctagatttggtattgaagatgacacgggagtttaatatctctatgaatcacaatatcccctcaatatcccccttttaattgtgctgttccttagaaggcctgtggacttgccaaaataactgtcttcaaggcaaattatattggatacctttcagagtctgttaatgctcttcttgttagatggctggaagggctagtgttcagagataacatgaaatgtttggctttgactgtaaagctgtgttctatccccacagggatgctgctcagacctctccacttcaatttaataaaagacagttgtatttcagatgtttgagagagtcatgttccaccaaaggcagatcatccagcattgtctgtattctctaacaccatttcttctggcaaaatgttttaatggggtattggttcttgattttaaaaagggcattgtgagataaagttttcatgttgtcttgagtgtcaatggacatacactggaacaatttaaatatcccatatgtttttttgttctttttattatttacagaagaatattctagttcttgaaagctgcatgaataagtaaccacttttctagtgtgagagtaatccctttccattttataagaggatttcaagttagaaaggagtctggtagattcttatgaactcattatgagtgaggtcaaagatactaagtaccagaggaggaaaatgtgagtcaagagtacatgaaaatagcaataacacatcagaaagatttctttaaacccctcaaggaggatgtcacttttagagactgctctctctgtctctgtctctatagtgtgtgtatttgtcccagctccatgactatgttttaatgttatacactattgagaacagagttattaaactaactaagtaatttatctggcttcaattctatatttcaatatgcaaataaaatataaatataagtaaataattatattattttttaggtatgtgtttgatgaaaagaatgaccaaaattaaatgagtgtttaaagttacaaagtaaaaataaaactcatttctagagaggatcatcattccattcattgtataagttatcaaaatgtattcttagatgagttatatcagaaaaacacctgagagttatttagattgtcaggctcctcctcagaccaaagaaatcagatcctctggtggtaaaagccagtgatctgtttcaagaatctccctgagtagttctgatgcatcttccaatgggataagcagtccccaatacagcatgtaatataaaaaacacattttgcttccatttttggcatatgtaatgaacataatattggtttcaccttagataatttatattcattacatacttaaaattattctatatgatttccttttattttgtgagcataattacataatctctctccttttctccctgaaaacccttctatatagtcttccttcctctatttaaaattcatgacctgttttccattaaatgttgttgttgttgttgttgttgttgttggtggtggtggtggtggtggttgtgtgtgtgtttgtgtatgtgcgtgtatgtaggtggtggaaatttggggacttgaaggtatatctttacaaattgctatgcaagcaaactaccactttcttttaagttccccaacactgtgcagataaggatgatatcagacaagaacatagaaaaggaatcagaggtaatctgtaaaaagcaatccaccatgtagaacaattttgtaattatatctatgcatatatattcatacatgtttaattttgctttgagtaaggggctatatttacttttatttgatattttcttccagacagggttctttgagacagggtttctctgtaaaaccttggttgtcctgtcctggaactcactctgtaaaccaagctgtcctcaaactcatagagatctgcttgtctctgcctcccaagtgttgttattaaaggcatgcaccatcactgcctggctactttataaaattgatagtagattctactctcatattatatatccctactacagttttctcttccttcccagattcatttctcctgtctctcacagacaacagtaagacaggaccaaacaagatacaataagacaaggcaatggaataggaggaaaacagttttaagaacaggcaaaagaatcaatgacacacctacactatcacattttcaaatcatactttctttatgtggtagttacaattaccacataatataatcagtagtaattactgataccatttttattccaaaaatgattttataatttgtgaaaggatagggagatgactggcattttctccaatatcttatcttgatatgaagaatataagtaggattgctttcccaaacattgtcttggaatataagttaatagttatagttttacattatgagataaacattttatacaatgtaaaggtattttgctctcattggattagcaaagagtcaactgaccaacagctaggcaggaagatagacagaatagtcacattgagagaagttttggaagaaaaagaagggcagagtcaccagcaaaaacaaaggaactagatgagcttgtcatgctaaaaacagttactgagccacatggtagtacacaaataaaagtatgggttaatttaagttgtaagaactagttattaaacaagcctgagctacaggatgaacatttataattattattaagtttccatgttttttaccggggagctagcagtcctgaagacaaaattccacctacagttttatgctttgcaatattttgatgcctttcttttttattccaacttgggaaggaaatcttgctcttttattcataagttttataataagtgaaacaacagaatatatctatgttaattgattaacttaacctgaataatgagttatgcaaagaatatatatgaattgttaagcctaatttttttttcgagtctataagtaggtctgtgatattttgcagagtattatgttcatacacaccttcacaaaaacatgttcaagtccacaaacctaagaatatgcttgcacatatacatgaacactcatgggcccacactttcatgttgattcacactgatatataaatatacatgcattcatgtggagacagactcattgcactcagactcatgtgcacatgcatgcacacaatccagatatgtcaagtcttcccatggtggagatattatatgttcacttacaattaaattatcatattgttggtacataataaaataggtgcatgcttctttaaactgaatttatttagaaaatccctacttgagctagttatgttaacaaggctttatagtttgagggccaatgaagaagaaatctttatttaaaatgtgaagcctctaggatggcatatagtgtactcatcaatcttgttatcagacaaagatatttaaggtagcctctcaactactgcttagattgttagctgtggtcaaacttgtagatctctggacatttctgtagtgtcagaattctctttaaacctataatggtttaaataattctttattatggtatcccttttcttgatctcctctctgttcttccctgactaaaacttcctgctctctcatgtccttctttcccatcctattctccccttctctttcttctatcctcctcttccctcccccatgctcccaattagctcaggaaatcttgtccatttatatgggaaaacatgtatgtctctcgtagggttctccttgtttcttagcttctctggtggtatggtctactttttgctctaggtctaaaatccatatatgaatgagtacctaccacttttgtcattttgtgactgggttacctcacacaggatggtttcttctagttccattcatttgtgtgtgaatttcaagattccagtgtgccatcctagagccttcatccagtagctgatggaagcagaagcagatacagttaagcactgagctgaactctggaatccagttgcagagagggaggagtgtagggtaagctgtagccacacctacttaggggctggctacaggtgtgcctgaccatgctttcgagggcgtggtcagggtgacatagagtgagactttcaggggactgcgtttttctctttcggtttcactttggtacttgctggacagactgctgccaagcgggctggctaggttgctctgtaagtaaggcttttccctattaaatacccttatatttctacctgactctgtattggtaatttcccactatagagaagtaatgaacaaagaggtcaagaccaggctggagaaatccacagaaacaactgacctgaacatggagttgctcatcgactccagactgatagctgggaaaccagcataggactgttccagacccgctgaatgaggatgtcagtttggaggtctgtccaatctatggggcctctggtagtaaaccagtaattatcccttgtatatgaatgcatgctgggagtccattacacatagagggatactctctcagccttgacacatgaggagagtctaaaccctgctccaaatgatatgacatactcagaagatcacccatggaaggcttcaccctccctggagagcagaaagggattgggatggaggcagggggacaggggaggaggggaaggagaaggatgtggaattgacatgtaaatgaagcttgtttctaatttaatggaaaagaaaaaaatctgaacaaattgttttaagttggaaaaaataaatgaatacataataaatgaataaataaaaaatatgaagcctcaacttcagatgctcatctacttgctataaggtgaaaacccaggactcacctatgagctaaagcctctttctgtgaagattataaattattaacaatttcacttagaataagacaatactttctagtacagctgcatgtgatctgatccctactggactcttctgcttagatttgccaggagcaaatgttatcacctccatctcagttggttaaagatgagacatgtttattttattctaagaatttctctaatatgcatgacattttctatggccaaaccagggtctacaaagtttaataaaggagattgccatttctcttatccccacttttcaacagtagtatttttccaatagtatttttccaggtggttgtgctgtgctccttttgatacaaggagttctaaacaactgcttttccaatcattaattttataacattttttgtaaaatcagaatatgttactcaaaatgatctgttatactctccctattgggtaacctggggttttcttgaagtctcttaaattggccagtgtcttactcaattgttctaatgctatgactaagcttcatgaccttaagtgacatacttcctccaacaagaacacatttccgaattgtttcaattagtgcgacttcctgatgaccagtcattcaaatctctaaaaccagtgggctttcaaaccaccttggtgaacaaaaaacagaaagagtgatgctatctaggaattgggttccagggagcttaagaagcttgggtttggttcctatgtagttcaattgtatttaatgtcatcatttgaatctcagtttagaaacattgcagtgtgtgtgtgtgtgtgtgtgtgtgtgtgtgtgtgtgtgtgtgtgtgtgtgtgtgtgtgcacttggtgcttggtacagctgtatatgtacagaggccagactaggacaaattctgtctggctctatcactctgtaatttattctcttgaaatagtgtttcttactgaacatgggccaagagtcctcagtcagtatgacattgcattctggaagacatgtttacatttatagccttttaaattaaatcacattataacttaaattcattgttgctatgtccatctcttttgatatcattacacattactatttattcccaataataacagaatacttgctgacaaataacaatgtgaacaattgatttttatggcttttagttacataatggttcagaagaaggcagactggttcttctgtaaaatgaggtcataaatgacatgtcttccttttctggcctctcttcattagtagaggctagcatagcttcaagacaaattgagaatatttttctacaaaaaaaaatggttaaagagaagagacccacagataacaaatttctctggaatggtgagaaactagacaaataatatctaaaataaaacaatgagcaaagttggtgtgttcacaaagaattctttaagaattcacacactggggagggtctaggccctgctccaaatgatatgacagactttgaagatcccccaaagaaggcctcaccctccctggggagcagaaaggggttgggataaagagtttggtggggggcaggggaggaggggagggagagggaactgaggttgacttgtaaaagaagcttgtttctaatttaaattaaaaagatatctctttccttgctgtcctctgtttttcccccatctcgaccttcctgatccctcatgttcttcccccctccccttcccctctctacttcctcatacctctctcctccctctctccatgctccctatttactcaggaggtcttgttccttaccccttctcagaggaatccatgtatgtctctcttagtgtcctccttgcttcctagcttctctggggttatcaattgtaggttggctatcctttgatctatgtcaaaatcaactttaagtgagaacataccatgtttgtctagagaaacctggcagtggggaaattcccaggaatagatggctccaactaagaatccaagcaatagtggaaaggctcccttaaatgctcttcccgtataatgaaactgatgactacattaaatgccatcatagagccttcatccaatagctgatggaagcagaagcagagatccccagctaatcactgagccaaactcctggaatctagttgtagagagggaagagtgatgggcaaaggggtcaaatccacgctgaggaaccctacagaaacagttgacctgatcaagtgggagctcacagactctagactgacagctggggaacctgcataaaaccaaaccaggccctctgaacatgggtgccattttgggtgttttgaccatctatggggctgatggcagtggaactggtatttatccctagtgcatgaacgggcttttggatcccattctctatggacagatattctctcagcctagacacaggaggtagggccttggtcctgctgcatattatgtgacagactttgatgagaccccaaagggattccttaccctctctgaggagtgggatgtaggcataggatggggagatggaggggggagtgggaggatgggagggagaccgaactgggatttgtatgtaaaataagatggtttttaatttaaataaaaacaattaaaaaatgaaaagtcattcagagattctggtgttaaaacacacaaaaacacacatgtagttgttttacagtttttgcttgcttgttaatgtggcttttatataaagttaagctagttaatagaaatattgtgtagtccaactcaaatatgaaggagaggttaaagattaagtttaaaaattaaagaaaatgattttctcattttcttaccttaaattattttattttataaatgagcttataaagtagcttatgaggttcatggtatagtttacaaatagattagagttatgtaatattaaaagtattaatgtgtacgttttggccttaagcctagtgttttagctatgttgttgctctagatatgactctcagggaataggagatttactgtacacagtatcttcatagcagttggggtagttctgtcaaatccttgattgtcatctttcatgtaacacaaaccatatatcctaagggacaaaggatctctttctcatcccctcttggtttttccctcttccttgtcctgtctcactagaaactgccactaggatcaagataattcacaagtctcctttatctggtttgaagtctatacacacacacacacacacacacacacacacacacacacacannnnnnnnnnnnnnnnnnnnnnnnnnnnnnnngaagagagagagagagagagagagagagagatggagagagagaaaccagaatggtaaacactcctacatcccagccaattttacaccagactgtttccatcctaattatgttatctttacttaaaatttctggcactccagcagttatctgagataatcaacttatgaaaaagagagactcattttggctcacaattttagagatttcagcatgcggttagccctgttgtttctgatgctgtggaaaggaactacattgtgctaggtgcaaacatacttatgtcatggtgagaacccaagaaaggaaaagagaagctctttgggctactgctgtccccttaaaggaccctttccaaacattaggtctcacctctgaacatttctgctactgccatagcaccaaggtgggacaagtgcatgagatatttaagatagataactttcatggctgtctctacctgtggaaaataggagttttcaagcttagctaaatcttcaagctgtgcacaaacccttctgaaatttatctatcattaaagtgttgaatttttattttttgccttcttttcattatcatgacaaactttaggaatgcctcttagaatgtttcatgttctaatatgtttgaagatgacattctacattaatataaattctactagatttggacatctctaaagaatggtatttctgcttatctcttctgaagtaagttgcaatgtgcatggtggacatttagttctttttactgttgtttaatttggttgtctcaaaaatttgattaaataggatgaactttgtgaaaaattaatacatatatgcatatatatttatatatatatacctgtttttgaagaaaatggaaataatgaaaaatgtgttttattatttgtagcacttgattgaagagcttggttagatatatccatttaaatacttttggttgcatgtttttcctttaaaaacctcacaggattccatgcactctggttacaggggagaattttcaagagtgaaaaaattcatagaggacatgtcagtttcagtcatcctttgcctggtctcagggtggtggtgctctataagttcggcatgtgtggaacaggattccatggagttcatcccctgacttagaagtcagtgacattatgtagtgactcatctacagatgataaataatgccagatgccatgctgcctttttgtgtcttttctgaacaaggactaacctttacaactttaagttacagtttcctactgtctactgagcagctaacaatagaaaagggtcccctgtgttcagctgagctagccaaaactctaaagttcagagaaaatagatgggccttcctgctttaatgctgcctttgacttccctgcatttcttcttttctgaaaatgtatctacattacatcttggagtgcagtggctgttccatattgctgagcagttactgctcaggttaaggtaaacacaatcctttataatctttccccaaagccttctgattaaatactgttccaggagtctgtctaagtgagagcagagcccagaaagcagctgcagcttaattgctgttggcatttcttttcactctggacctggataggatgtttctctttgtctttttttttattattaactttaattactgcaggaatgtgttctttagtttgacattctgtcccccccaccccaacctaagttagtccttaaaggaacatgagaatcaggaatcagtattgggtcccaagcagcataatgatagattttaaatattacatgatgcatctgaggaaagagccgaaaaccgtaataattttaaagatatatagaagggatatagacaaaagcaaatgttcagtatttgtacttaaatgtcacgtttttcatttgctttgtttcaccactttgtatccactagtgtaatgtcttttttagcttcaagaaaatgccttcagggaaatgttgtaaagaccttaaccaagtaaaacataagcatgccacaaaaatatgaatagaacaaaatcaaacttagcatagaataaaaccctgccttagtcccatttttttttattgctgctgttgttgtggcaggatataaaactctctatgttgatgaggaggactttgaactccttatctggcaacttgcacctccctagtataggaggtagggcctgtgccaccatgcctcattcaaaatcaaactatttcatccaactcaccattccattcttctcaactcatcatcaatatacctatgggtcagaattcttgccatttccaggcaagtgtgaggccttgttcctcccctcaactgtaaaatgcactacttcataagaatgtgagataattccctagatatcctaacacttccttctagtcagctttcatgcagtatatgtattaatgcttttgaacattttaacacctgctccttttagaggtgcaacttgactattgaagtatttaattagtcattgacaggctccaggcagcaactgtgtgcgaatttaccttgcacagtcaggatctacctgttgaactattaaggaacaacttacattgataccttataattaggagtctctattaccagaatattttgaaaactgggctgtaaattattttccaacaaatgtaatttaccttatgtatgcgtgcaagcatgtatacacacacacacacacacacacacacacacacacacacatacacttaagtaattgtatgaataaaactttagtccttctaaaacttctatttattcaataggataatgcctaaatcatgttttaaaacaatattcctattaaaggtcagcacacttccttgtctctggtctgtgaaaacacactgaggaatatttttaaaaactgtaaactcaattgctccaccaacataagttcatgtggaactctgatgttatttgaactattattgatcaccactcattccatgcttcattgtgggtagtgatagcagggcagagaatttgggttcttccttttccagggatcatgaacatttttgttttgttttggaattcagacaattccattcaacctgacagcctgaaaggcattagtatttagtgatggggcttttaatctctttataaaaagtttctgtggggtcaacatcagatcaatagcacactgaagagtgcatttagactttgccatgtcacaaagacaaactcatgtttttcattcccaagtttcagggtgtataattcccagcagctagatcatctttcctttcaagctccataaaaaatactgatttattttttgttttgtttttttttgacaacatccagcctagggagaacctaaaaatgcttgatgttgaagagaaatccctaaaattcaaaggctgttcaacattacttcctgaggcaatgacagagaatggtatttttattcaagttttcaacttgagatttatttttttgagtatcagaccaactagaattcagttcttggtatgatattgtaagtatcagaatacatgtatacagttttataatgtagacactttacataagataatatttcttatactttaaataggaatctatgagttatcttttgtctttgaacagtagtgcagtgaatctctaaatattacaagtaaaaatacaaaagctcagttgatttggccaatatagtcattagaaagtcataattccttaagtgcaaggttaagttgaaaatataagtaaatacgatgaatgggtgaatggtctttgggtcatattgtaaaataagattcctgatagagttaccttggtgtttttgactcttgctaagttttagcacactgcctactagtgtaattttgtcttttgtcacattagtttaagctgttattataacaaattaagtaacaatttattttggaaaatttacagtttatctcatcttcaggaaaaatagtctcctttgattgctattgatattgtatgtatatgtgtataattcagaccttaagttaccataaagaagtgatttctattttggcttttaagacactgaaaatttcaaaatttgaaagtacccaataattttagctatgtagaatacattccattgcatttacttactatgggaattcacagaattgactccattccattttgacttaaggtcagagggttttcacctgcctttgctcctccaaggtgaaacaataaagatgtctggcccaagatgtaaatgcaccatgatttttgccctaaggtgtggtctctgcatgtgttgcctaaacaagagaaaacctaattcaggatatagttacttgatgcttcaggtattgaagaggtaattactctgttccttgtgtcattggaaaggaagtttttgccttctcctcctcttttaatgagggtataaaaatctctgaacattgaaacttgagtatattcagtatttactgaatgccttcatgactcgatctcttgtttcttgtctgtatttcttcctcagttcatactctccttcttaggtactaattcagattagttggtgggcccaggcagacggaccctcaatgtgggctccagacagatgcccccacagcatggagttacaacatatgtcacccaacataggggccaagacaatttaccaactattataagtttaatgaatttgcctcattaatggcacacacttctacccctcattattactaaatcctccccttatatttgttattactttgcactatcaacaagagagattggaggaattgggtgaactttgaagagagcaatggatatttaggagttagaagatgaaagacagtgacattgaattctatgtattctagtgtatgtatttagtaagaataaagatatgcctttgtatagttacagtgaggtaatcaaaatcatatgttaaagttttcccaatatgtcatagttaactttagctctcaacatccaaaagagggaactccaactgaataatttcccacataagataagcctctggccatatctgtgaataattttcttatatactaattgatgtaaaagggccttgttcactgtgggctgcaccattctatggtaggtagacctggcctatttaagaaaggtagaacaagtcagaggaagcaagccagtacataccatttttcctggtttatacttgacgttcataatcctcaaagatggactgtaacatgaaataaaatagcctctccaagttggttttggttaatattttataacaacaacaggaagaaaatcaggacatagatattttaataatatatttcatagacaaataattttatttcagtgtagaatcatgaagtttattaccctgcccttccctataagaatttcctaaattgaaataggcaagtcatttgatagaatattgaataatttgggtttctcactatttgattaatgctattccatttcagtgagaaataccaccaaagtgataacattcctttcttatgctttgcagcaaaaggcacatgataggtgctttgattactgcttacattaattttgattagtcaagctgattgcaaagcttctttgtagaagtacttagtttacaaacttgttatttatatttgtttttaatcatattttaaaagtggtctttaaaatggtctcagtgcttaagtataatgagatgaaaaattagagagttaaaaatctctttattagaatttaagggaaacacaatatatacagctcaatgggctatttgttaggcaaaaaaactcctccaaaaaatgtaatgtttttctactatgaggataagcttgatcatttagaattatagggacaggcttattgtatggaatatagcttttattaagttgctcatatctgtccataatgctaatttttataaccatataccagaagaacaagcatgggagtaacaataaaatcctgtttgttgcttatgacttaatcttcagcttctttctgctcttttgtattcactctatgcaactaggctatctgtctctatttcctgtctgtctgtcaaggtagtcctttgataaaaattagagtttcacccaaggtttagtctggttattcttaggcagcacaacagaagtgtctgtaattattttaagtgacataattctctcattacaaagatgatcaatctctgctcctatggtagaatgacgatgggatgggtttaagttgaatatttattctcaaggtctttctatttgaatgtctcaagtaaaaatgggagctggtgtctttcattgatacttctctcatgttatcaagcagcagtttgacttgaagtgttctttactgctaactgcagtgtctaaatttgctgagctcatatgtcaggtagagtggggagcaagttttaattaggctggtggtagtctggaagaagattctttgttactcaagggatattgaggtagtgactggcatacgcattttcagttagacatttcaatgtcttcattatattagttgttggtatccagagatatctttggaaacacccattattgagtaattccacttgtactttatcattttacccagagctatttcagatttctacctttattttctatctgtgtcatgagcgcctggtcctatttcttggaaatgtatcattcatctttattttctatgagtcatttgatttttgacattacaaataaagacagttttaaattaccacacaacatgcatttggtcttagcatgactttactctgggcgtgtgagatagtctaacaaggagttgatctactgatagtggacttattcacctactgtaaacaaatagtacttaattctgcagggatataacacaatcctatacatttgactttctccattattcttcaaattgcaatgttcttgatcatgagaagcccaacaggaccatatgagtaagtaaaagaaaaaatatatgtacatatacagaaggatgccataacatttaaaacactcatattcacttggtttacaaatgtaaaagataatcttgagtccagaatgtttaaaaaaagggagagcaatattagggaaaaatagaaatgaaaataaatggaaaagaattactaaaattaactcaaataaaatataaaatatcctcttcagtgaagagagcatgtgcccttcaatttctaatgttctctgatacaaacaaccacagtacttccacaggaacatgcattctaggagtgtggatagaaagatggagaatgaatatgaactactgtatagtgccagaaaatggtgaagtttaaaagcaagcaaacaacatgatggcaggacatatcaaaagcacataagaacaacttgacatgagtgctaatagcaaaattagagaaatctgaatagaaatagtatcaaactcttcttaaagcaaaaatgtaaaatgtgtatcatattgaaaaataaattctgcatttctcctaatctggctctatgtatgttttaattcttactactactcatcttaatgtcatgtattaatagtatatttagttacactagtgtgttttgttagcttactgcagcaccatctctatgattattcattatatatccgcaattcttttgtatgttcttctcctttataagatttagtcttttatgtctagctacagttaatcattttatttttatttaacttgtacttagtagaaagtatttgcagaatccaatgatgaagtaatatagttataatttcaaatgtgtccttttcaagaatattttctacatgcaatagtttagttgtattgcttctctgtgacaggaaatgagctagaaaattgttagcaacattaaatagattgggcatgctacacacacacacacacacacacacacacacacacacacacacaccacaaaaataaagagaaaacgtaccatgaatttgaaaaagaacaatgtgggagtaaggaagggacagagcgaggaaagacaaattgcaaatgattaaattatattcttaaaattaaaaatatcataaaattatttgttttttgagaatttcctataatatttttgaatcatatccacctcatttccaactcctctcaaataaattaagaagtgggaaattcactgatgtaaattagcttattatttgaacatattctaacttatttgaaataggatcatcacacttttcttctcacatattaacatactttgtttttcatcctttcaaagtattatttgataatgttataaaattggtagacaattatgatgaaatggacactagatgcacacatatgtatatttttatgtagagggagacagaaaaagagggagagatgaagaaagaaagtaatttgaatttgaatgcatgtgttaatagtatgccactagttgatagacataatgggtagactcaagaatgatgaaaattttaagtccaaacagaaaaaaaattcattatgctctgaaatttaatgatgtatatatacataaatttaatgatatatatacatatatatgatattactttttccatttgtgtttagatatgtactttcataggaatcagaaaagccaaatgaatagccatcagctacagaaacatctgcatgtatacctctgtgtttagatgactatttcaagtaacttggaaaagtttgagtaattaaggaaagtaactttatagtaaaaacaatatatattattattaaatataattatgccaacttaaaaatctctttgttctttaaatgttctgcctagagaggagctgggagcttgtcttagctgcaacaatagctatacagtgccagtaacagctttctgtgtaccataggtaaggaactgtcaaaatcatcaaacctttaaattctctactcctactcatcctattattctgtttaatcttttgttttagctatttttattcttaaaggagtaataaatgcacatagtttaaaaagtcacctagtactacaaggctataataaagcactcagacactattgtctcagccattgttacctgactttctatagataaggtgtcacctttccaaaagggcttcgttctatggatttttcatatttaaagattgatctttaatggttatttcttgatttgtgaactcattctggtcttcaattttatggaagactgaattaccactcaattgtgagtctcatttctttcatctttctaaaatagtatttaaattaataccatttaccatataaaacatttatttattatgataattggttcatcaataacacctgtgtttctgtttttcctgttgataagggttagagatagaacaattgccaagcatgtctaaggaagaatatttctggatgtatatatcagacaattaatgagtgtgaatgctttctataatgttatttaccgtgaccaaatatttggcagaatatattagtcacatttgttcaagtcctctctgttagattttgtggtcatcttactttagttgggtatgtgggtgtatctcttatttcagttgggtagatgggtctaactctttcatcttttgggtaagtgggttctgttatctcttacttcagttgggtatgcggatcttctgtttctttacttgggtggatggatatgcaagaaagctttagaacaagagtgactgaggcttctttttccacacaatggacttttgataaactggtggtaaagacactgccggatcttatgcctcttcctttcttttagatttaattttcaaactcaggaaacaggtttacttgcttcttgagataatatttcacataagtaaatattttaattcttactactattactttattctctgttttccctcttaatttgttacagttgcagatgtttcagttctatttttccatgtcattgggaagagtttgtctcaatgtcttataacttccatggtagagaatttatatgctcatatctgtggatgaaatttgctactttatttaatttaatttgaagagctctaagaatgttttggatcaatggtttctaaaattgcattaaaatgtatcctacatatacttgattctttttttgttttgtttgtttcttttttgaggtgactactgaattatttcattacatttctgaaaatactcttctctgctattatcaaaaatcaaactgccatcatcccatctcttactcctactagaatggagaagaatgttcactgttctataccttcactagcatagtgtatagttattactctgtattttagtgattgttttaaattgtaattctctcacaatatccaaggaatagcagtctctttttgagtgtattgctgccctctgcatgactttgggaaaaaaaatcttcttcctactcctcagttgaactattaattctccatatgttgaggtttgcgagtttatgttttggatgccatcaatttctcagatatgtctgttataaatgctatctttctgtctatgtctatcttcagttggtatgaggtggccttttgcagtacagtttcacccatttttcatcattcaaaaaggtgttgacatttttcattttctttgacactgtgctataggtatatagatataaagctaagatataatgcacaaaacatgtaacatcatataccaaatgtatacttttaaatttatatgtatatgattatatatatatatatatatatatcttattaaaattttataccaataacccattctacaatgtgttgtttcccattctttttatcttctctcaatgatttacacaatataatatttcttggtctgttttctttaatatacttaacaccatatgattcatcttctttttgtatatccagtcccacaagggcagagaatttgcttcccttgcctatgtaagattaactgtcacaatgagttattcaatctttatctgttaggttaatgggtgtagagacaattctaaatcacataaggtttgtaattattcattttagtttctgatctaaaattgttattcatcacttcagtttcatccaaatgtaagtaaacatcatgaattagtaagttttggccacctgacagagagaatcccttacaaacatctacagattgattccaaggtgattgtaggtcttgtccagtggacagtgaacaaagacatcacatatttagtcaaaatgtatattattcaaggaattatactcattgtttagtcagaaattatatagaatataagaaaaaatgtagcttttctacataaaaaactacgtgtaattcttatttgctaaattccactaataagtgtctgctacgcaaaacattacacttgacacctttgtgtttcactgttttaaatatgtgtataaatcttaaaaataagcacagattgatataattttagtaatctgatttttgaaaacattttttgtgttaaatcatttagcatttacattaaggaatattaaaacctgttcccagaatgcaggttactgacacatgtttattttgaaatgaacacatttttctgagtccatgtgtcctgaataaggatataatagaaagttattcaaagttctttatgtgaggaaatggtgttcattatagaataagtgaagaaagatgatttgaaacatgtacatatatatttcaaatatatatatatatatgtatatatatatatttatatatgacatatatataggtgataataattagcatgttgactactacagggcttgattttttttaaagattttatttattatgtatacaacattctgcttccatgtatatctgcacaccagaagagggcaccagatcacataacagatggttgtgagccaccatgtagttgctgggaattgaactcaggactctggaagagcagtcggtgctcttaacctctgagccatctctccagccccccagggcttgatttttgtttaataatttcctcttttcagcctaaatttgtacctcacctctgttttctgcatcaagaaaaatctttctcctgtctggattttagtgaggttaataagcaaatgatgggacaatcataggaatattttaagaacactaaaatctcataggtagatattaagagatgaaacaacaagatagtttcaatacccaaggacagataatgaaaccttaaaaacaggctaatccaaaagaaattattttaaagtttgcttcctataaaaactgggatgaaatggaaagaaaaaagaaaattcacaatgaggctattgtgagtctgaacagagaggaattaccagtaagaattaataaagcaagtacaattttgattaaagaaatgtttggtaggtcattagtatcatgaagaacaggagtagtacattaaaaaatctgtatgtgtgtgttcccgcttgtctttatgtgagtcatatacatacgggtgcccatagagaacagaggatagtgtcaaagtccccaaagttacagggccttgtgatccaccaacatgggtgctgggaactaaatccaggtctctggaagaacagcaaaagttcatatccactaagccttctctccagtttgccacatgcgttttatacagcattgtctccttctctattgagtaacttgattgactgatgaggcagaaatgattatttttgcatatgtagattcccacataccattcattaccaatggacttttgacataatatagaaacttctgagccagactacttatcctttgaactaattttgaatacaaaaaaattccttgttaaataaaagtatataattttataaaatattgacaagaaaatattagtgtattcagattttgttctatatcatatcaagaaatattaaaactaaacacacttccctaatgaataccttataaaaccataatattttctggttaaattcacatattttaattgtgtaataaaatacacaaatttagagagaacttaggctttagtcaataatttctctaatggccatattttattgaaatatttgggctatttcataattaatcttgattgtctacttgtttggtcctggtatcaactaagagaatttcctctgggcatgtctgagagagcacattcataaataacagattgcagagaacgcacccttcagcagatggctgccatcttcttgtagtagaccaaatgctatgaggactgagggataacagtagtgtttgcgtgtctgcctatctcttggtgttggctagttttatgtcaacctgactcatgcttgattcactggagagaaaggagcctcagtgaagaaaatgactccatatgagtaggatctacacaaggctttagggtgttttttaattagtgatttatggggcagtgcccagcccattttgggtgatcaataggggagtgcccagcccatagctgctggtcctggcttctttaagaaagcagtatgagcaagccatggggaataagctagtaagcagctcccctccattgcctctgcatcagcttctgcttcctggttcctgccctgattgagctcctgtccagaattcctttgatgatgagcagtgtaatttaagtatagtccaattaaacattttcgtttcacaagttggtttggtaacagtgttgcatctcccaaacagaaaccctgcctctttttgatatgaccctttgttgattttactgccctgtatatcaatgaaataagcactctgttttattgatcaacagccctccatgaatccttcaagcattcagcgccagattgagaccatttagatatcaagactcatgggctaacaagctactgggttctcagtctctctagattccagataatcattgttggagtttcacactcctattaggtagtctccctttatattgtatattcttcctattaattctgatcctacagagaaccctgactaatacattttagtgaaaatcaagcttagacaatatgtatgtagactactgttatctctgaagctcaaaatgaagtgagtcatggcaaaatggataatacataaatgtggatactttgattattctccccagatgacatacttggactaagctgaaatcttttggtctatgtgtttggtcaatattgtggtaatcaccatagataggaagaattgattccttgacaacgcatgagcttattcatgcctacaatgactccagagaacactagcttttcttgttattgatattatcattgctaactcagaattggctcagccaaatgtctcattatagaagcctgagcagacaaaccagtgacctgtgctctccttcagtaaaagcttctggtgatccacagttacaccattgtactattctatttctgtcactgggctgactactatcactggcagatttaaatttagtaactgttaccttccattcaatatgcacatatgtggattgaatatgttttcttaaaattttcgtgtgtaaaaatcatattgaactaaatatatttttctcaaagtactgggtaaaagtgatttagaatatgcaaatagaaaacactgagtctcagccaaggtgattttgtaatgtgtgtgtgtgtgtgtgtgtgtgtgtgtgtgtgtgtgtgtgtgtgtgtgtgtgtgtgcatttgaagcaaaaaaattgggaacactatcattccagattgacagtgacatgaataagtgacatgatatgggaattcagatagaaagtaaacaatctgtgagctagaatatgaagtgtgtgagaggattttgagggaatattggaaacaatttcagggctacttctttgtcatttttatacttttaaagaaaatactcttattcagaggaggataatatccatattactatcccattttactgttttacaattcattatctgctttatactttaaaattcctttgaaaaattcagaccattcatatcgaatttgatgtttctaaaagaaatccaaacgttacactctacaaatctactccgataaatttcagtttcatgttcaaagtatgtaatattattaaaagaccagtttaggaaacaggattcattagacaacaacattttaattttctcataattttaattgaaagtttctcccaaacattcattatataagttctgtttttcccatatttaggggcagtactgttgcattttaattatatcctttctgaatagtgacagtaacttctatgcctttaagttaaactatgatcaccattagtcttcctttcagattggtacccgaaagatcccccaatattataattttaatttcacaccagtgctcacacctttcctaaagccattttgatgaatattactaattccaattacttggaataaaagacctccaggattgggagttgagatataaattgttacctatgtcttcttcatatttctatggactttattgtctatgaaaggtagtggagagttgatgcaaaccagtcctttctattgcattttgttgttttactcaaaattttttaaaattaatttttatttaaattaaaatcaatcttgttttatatacaaatcctacttccctctcactcctaacctcctatccacccccaaaccccatcccacctccctccatccaccactcagggaagatgaggcctcccatagggaatcatccaagtctatcagatcatttgcgtcaggacctaaaccctctcctcatgtatctaggctgagagagtatccctccatagagaataagcttctaaaacccaattgtgtactagggataaatgctggctcaactgccagagaccccatagactgtccaggccctcccaaatgacacccactttcaggagcctagttcagtcttatgctagttccccagctgtcagtgagctcttacttgctcagatcagctgtttccatggattttctgagcatggtcttgaccgatttgctcattgctactccctctgtacaactggattcaaggagtttggcatagctaagcactctgtcattctctgcttcttcttcccttagctaccagatgaaggctctattatggcagttaaagtaaccatcaatctcattataggggaagggcattttaggtagcctcttcactactacttagagtcttagttgggctcatccttatggatccctggagatgtctctagtgccagataccttgttaagctataatggctccctctattaaggtatcttttcccttgctctcctcagttcttcccccaactcaaccttcctgatacctcctgttctcctcccaactacacttctcccctcctctttctcctacctccctccctctcccctgtgttcccaatttgctcaggagaccttgtccctttccccttctcaatggttccatgtatgtctctcttagggtcctccttgtttgctagcaactctgggtttgtggattgtaggctggttatcctttgctctctgtttaatatccattcatgagtgagtacataccatttctgtgtttctttctgcatctgggttacctcactcagaatgttttcttctatttctatccatttgccttaaaatttcaagatattgttttctttttttactgagtagtactccattgtgtaaatgtatcacattttgtttatccattcttttgttgagggcatctaggttgctttcaggttctggctaatacaaataatgttgctatgaaagtagttgaacctatgtcctttgggatggatgcagaattgctggaacttgaggtacattgatttccattttcctgagagacctccatattggtttccaaagtggctgtacaagtttgcattgccaccagcagtggaagagtgttcccctttatccatatcctctccagcataagctgtccttggtgcttttgattttagccattctgataggtgtaagatggtatctcagagttgttttgattgacacttccctgacagctaaggatgttgagcaatttcttaagtgtctttctgctatttgagagtcctctattgagaattctttatttagatctgcacccaatttttaaattagattatatgatgttttggtgattagcttctttatttcttcttatattttagagatcatccctatgtggatcattccctattgtgtcagctgccattttgtcttgatgagtgtgtctttgccttcagagcttctaagtttcagtaggtccaatttattaattgtcaatctcagggtctgtgctactggtgttattttcaggaagtggtttcctttatgaattagttcaagggtacttcccactagaggttaagtgtggcaggattttgatccatttggacttaagttttgttaaggagaatatacatgtatctatctacaatcttctactgtcagcattcagttataccagcaccatttgttgaagatgttttcttttttccattgtataattttaacctctttgtcaaatatcagatgctaataggtgtgtggatttatatcagggtattcaattcaattccattggtctacctgtctttttgtgtgccaataccaagctgttttcattactatagctctatagtagagcatgaagtcagggatgttgatgcctccagaagttcctttattgtacatgattatttggatatcttggtttgttttggtttttttgcatataaagttgaatattgttctttcaaagtctttatagaattgtgctgagattttgatggggatttcactgaacctgtagattcctcttggtaagattgccatttttactatgttgatccttcctattcaagaccatggaaatctttccatttcctgatatgttttttaatttctttcttgagagaaagttcttgtcatatagttctttctcttatttggatagagttaacctaacagtccacaaaattggaaaatttaaagtaaatggacaaatttcttgataggtatcacttaccaaaattaaatcaaaaacatctaagcaatttaaatacacccataaccccttatgaaacagaagcattcatcaaaagtattccaatcaaaaaaaaaaaaaaaagcccagggccatatgatttcagttcagaattctaccagaaattgaaacaaaagttaatacaagtactcctcaaattgtttccacaatagaagcagaaggctcattgccaaattcttttgacgaggctactatttccttggtacccaacacacaaacacacacaactaagaaagagaactgttaccctaagtctttactccatctttctgagccctgccaccacatgggcactttccacctggccacccgatttccaacatccaccacaagtaacacacagagacttatattagttacaaaagctccttggccaatgactaggatttctcatctgctagcttagtcttaattatcaaccataatcatgagacttatcttatggtagacataggccttgtgtcctgtcttcctgttgatcacatgtggaccccacagagaggaggaagaagagcaaaagaacgagttccttcttgtccttgcttatatataagtctgcctatgtctcttcctgcctgtatcacaagacttcctgttactacatttctcacaatcctccttgactcctagtcccgcctaacttgcttcttcattgaccaacagtactttattcaacaaccaataggataaacatgcacagaaggacattccccatctctcctcttttctctctaaataaaagaagggttttcaatataggattggcaaatggatgtctttcactttgcagaatttggaaaattaaaatacatgcatcatactatagatatatttcagggtttcaatgggctattgcttttagctttgaaaagcttattctggtattacacatctgttagaggtgatggccattatgggtatacctgaacaaattaaaactgacaatgttccagcatatgtctccactaaattgggacagtttttcaaatattaaaacataaaacatataaccagtataccacacaatcctacaggacaagcagtggtagagatctaatagaacactagaagaaatgttccacaaacaggctgggggaacaacccccctacaaaaatcataggttatataatgcattattaacactaaactttcttagtgctaatgagaaagggcaaacagctacagaaagaaactagactacagaaaaaaactgcagaactgaatcagccagaatacttcaaagatgtactgacctctgtatggaaaccaggacatgtgttatgttcgggaagaggtttcacctttgtttccacaggagaaggaaagatttggataccatcaagatcagagtataaaaacaaaaaaaaaacataccaaggtatatctcataaattgtataggaacctcccaaaggaaagggacagactctccatgtgatcacaggggagagaggatgcatgccactggtgtcctggataagataattccttaaaaatatatagattagtagttatggttgacaattaagactgaactagcaaataagaaatccttgtgattggccagcaccattgtaactactattaatctctgtgtgttatttggggtgtaactcaggtggctggcagaaaaagctatcgctacagagaactacagaccaataaaccctataaacattgattcaaaaatactcaacaaaatactggcaaatcaaatccaagaacacatcagaaaaatcatccaccatgatcaagtagacttcatcccagtgatgtagggatggttcaacatatgaaaatccatcaatgtaatccaccatacaaacaatgaaaatgaaaaaccacatgatcatctcaccacatgctgagaaaccttttgacaaaatccaactccccttcataataaaggtcagggataaccggaacatacctaaacataataaaggcaatatacagcaagccaacagaaaatatcacactaaatagagagaaactcaacgttttctctctaaaataaggaacaagaaaaggctgtccattctcttcatatctctttaatattttacttgaaattctagctaaagaaataaggtaacaaaaagagatcaaggggatataaattggaaaggaagaagtcaaactttcactatttgcagatgatatgatattttatataagtgacctgaaaaattctatcagggaactcctacatctgataaacaccttcaataaattggcagggtacaagattaagtcaaaaaataagtatccctcttatatataaatgataaatcagttaaaaaataaatcatagaaacatcacccatcacaaacaacctaaaatatcttgggggaatttctttttgtctttcccagtgaattttaccttgcttacctatcagtctctccttgatgacagaagaaaatgtccctgagccatcaaacttaatattccttccagaaatccatttggtggtccatcttttttctattagatgaatgcttgtacacagaattaagtcagggagcatttaaaataataaattcccagcatttgctctccagaacttgtataacagtttctgcagtactgcaagacctcatttaaagttttcgttcacatgtgaacaaatagttctattggattattattattgaaataagcaagcaaaaccagttaacctttaagattattcaggatatttccttgtggtgaaagatgaagcatggggtgatatcattagaagaagttagctaaacaacacgagaaatctcttaaaagggagagtgatgggaaattaaatagctgtagatgccacaatatttggtgacatgttctaattttatgacattaaaattactaaaacaagtaagctatcacagtacacacacacaaaacatatatgcatgtatacatatatacctaatacatacttgtattcatgtatacatagctatacacacatcttgtaaaagtactttacaatagattattttgtataaaactcttgtttaatgtccaaaattatttcagctgctctcacttactagagaaaatagaattttaaataaggggtatgtgctgaagagggaagtaatagtattctcatagttgtgattcagtgactgaggcagctgaggcttagctatttagcaagagaaaaactcttgaagaggtttgtgaattaatctggctgaaactcaacaatttttggggggactgcatttagccaagaggaagtaaaggcctgagcactgttaaaaatttaatgaaacagatggcccattgttgtgcaatagagccactacaatcaagtctgtttttaaaccattttaagacctgcatgtattgacatacagaaaatagatgcagaccatagagaatatatctagcagtagtatttttgtcctcaatggatgagtgatatttttttactgaatactttttggaagaatggcattacaaaggttagtgcatttaaaagaagataaaatcagggatatttcaattttcatcacagacaaactttttgatgaaattaaggggaacagtggagtgggaaaaaagaattaataagtggtcactaattttcatagtgataaaaccaaaataagcataatttatgatatacttaataacagaatagtcaaggctgtgcaaattcattttatagctcaacaatcttatagaaatgccaagtataatgtggctagaccaaattctattcacatgcagtgtgagatagtttgggagaaaggcaaattattttgttgctggtcttcttgggaatgcaataaagaatgcttgaaaaatcgtgagagccaagtacctcatcctagctgggaaaatccaggctgtagagtcagtaaaatcaaaactgaatttatgaaagatcttaatacttaagttgcctatagttgtccatcagaattatattaattaactaatttattaactcgggcatttttatctgatttctgaaaagagtagtagccaacttcccctcctgtttttttcaatgaagggtcatcacaattttatctactaacatatttctgcaaacgatcattcaaatatcacctttaactgcaagaaacagtgtcttcaggaagaacgagagatttattatgttgaagatgaattgcttctatagtaactgctccatctttattccccctttccagtattttctagaaagattattcttagcttactgcaagtcctttatcatattttataatttactcagacctggactgattctctttctcttagaccctctatttacttaatttccagaaacatacatttcttatgaagagccacactgtttgaaagttcagcccttctttatatctccagatttttattatagattatcaattctctatgaaatgaatcaaggacagaacttggtaccaagtaagtggggtcattgctgtaatcaacacaaccatatggatttttgaacatttgaaccagttttgttagacaaaatgtagaccagtttaaaagtatggattggaacaaaccatttggtgctttgagaaaaactgatggggtagtcttatggaagcataaaagatgagaacattgagaaatatgagaccaggaaagtctcacatcaccaggtttcagaggggaacaaggatgccattaagaacaaagatgaacataatttctgtgacacctttgtttaaaaatctggccttagtttgtcctgagaatttaagtgtgtttatttaagaaaatgggtttgcttggaaaggcaaatctcagtatagaagattattcagattggtgctgaggaagcagctgttattgacactgaaatcaacactactttcaggctctctcactgttggttcgtcattcataagctctgtcagctaaggtcagctgtctctgtaggttcccccatcataaatcccctggttggtatactgtgtcttccctttcatgaacaagactcttggagttcaacgcagtgtttgtctgtggatctctccctctgtttttatcagttactggacagagaatctctgatggcaaggagggaagtcaccaatctgctcacagtcgattgccagttcaggcaccctctccactgttgttaggagtcttagttattaggagtaaaggataggacaaccaaccaacaacccacaggtctcagagaggctagataacaagcagggcccaaagatggatgcatggatttacctgggaaggggaagtaaaaatgatttcctaggcaaactgggggtgagttttggggggatggagggatgagaataagagagagcagttggaatagctgagtgcaggagaggggttggagacagggaattgttttttgaacttttctgtttccaacctgggccacttctcctctcctcccatgcccccaccagctcttgggagggcatcagttggccttagtgtggataccccatcagcatagcacactacaacccagaactcctggactcaacattctcctgtctcagcctcccgagtaactgggactacaagcatgtgccaccatgccatgccacagtactgttttcaaagcataaaatatgtaagatttcagaggtcctgtggtgtaactgagactagacattgctgtattttgttttatgcattggtggctattaattcgctatgttcctatgctttcatttaggaataagagtgcttactatttcattatttgatgaaaatatttaacttactttttattttatagagattcagttaggagactttagtttttgaaagtcttgctacttttaaagattctaaagactctaaaactgtattgtatttttatatcaagtcaaaagtaggactttgggcacaggagttgaagggttttacttcagagtgatgtctttggttgtcatgttgatgaaaggtagagttgtaatggtaaattttaattttcaattggctagaacttagaatccctttggaatagagtcacaatgaggtatcatgtaggtcatattgagttttggactgtgtgggattgtcttcattttcttgctttttatggggtaaaacactacctgtacgcacgtggcattattctcaaattttaagcctttgactgtttcaaagccagctgagaactaaatatgtatgcatttgtttctattcttgattgtaggtttcctgtgaatagcttcaatttcctgctgtcctgacttgtctgcaatggtagactgtagccttgaactgttaagttaaaataaaccctcttcccccacccccagatttatttttgtcaaggcatttaatcacagcaacagaaatgaaactacagcactatgtatctactgccaattgcatttctcttgttaactctaattcaaacaatattgttacatagatcatgtgttagtgttacttatatagaaaattgttttttgcttattgtttgttagttcttaatacttcatgctaatacttttttgctgtacacataatcaactttattccctagttctcttcccacacattttattgatttatagctattaataattttgtacatgtggcaaatttttaaatgtttgattctcattcctcttttcttattagcttgacacatgctagggatttgattttattacattgttgaattattaaattatggagaatattctacaatctgttatatgtagctttgatttctcttccttgtttccacttattggttataccaaacatatcaccaactcaaatttatccagagttatcatttgaaactctttcttgaatagaatggcatccaactttcaagcattgttgtctcacaaactcatgcttttggtactctaactctaatgagaaaataatttggttgatttgagtctatgaagtgctcaactacaaatggggcatttgtcaaacgccctctgttccaaggctaagggaccattgcattagaggtggcaagaatattgcaaataccagtgtaggggagcacaggtgtaaactgtgtcttctggaaacattaggattgttctctgcattaagaacctcaaagcaactgagatttcaaccacaagtactgcacaacattaaggcagtcagcatcctaacacaggtgggagggactcatgggtctccatgtttaactaaagtgttgtgggtagataactgtttctggtggaggctattacttctggaaggttgaccatgctccagtggatggccccataccaattaatacataggcatcataaattaaatttgactgaatattttcttaaatgaaaaataagggaaaaggttgggaagatgagatgatagtggatcacagataacttatgggaaaaggcatgagtaaatatgatcaaaatttgttatatgaaattctcaaataattgatagaaatatactcttaaaaacaatatcatcaaaactataatctccaagaggcagagaatggtgctaaagaaaataatacctgctaaccacaaatttgaactagaagattttgttctcttttctattgttcattttcttttgaaaagaacttttatcatttagcctattgtaccttaaattttcagtacaccccaaggcagccctgagctgttgatactcctgtcttagcctccagagagctagagatgtaccactgatgctcactttgtaagaactgagttattacaatctcaactggttgaggtgctgggaaggatatttatttgttcatctatcttttatttgtttgtttattgatgttttttccttgttcacatttttactccctctcttttagtgttaaaataagaatctcaaatggtataaaataaagctaaaatgattgacatccccatttgaactcccttcaaggccattataaattagtcccatgtgtataccccagaatgcaccctcacacacagatatcatgcatacacttgcattcataagaacacacagataccatgcatattctcacattcataagcacacatagttatcatgcatatgctcacattcataagcacacatagatacaattcatatactcacattcataaacacacagatatcatgcatacactcagattcataagcacatatacatatattcatatccacagcaatatctaagacaatattgtgggttttgtctaacaactacatatgtactaattagctattgctaaagagatacaaatttagaagaaaaaaatgtgtcaaatgacctaaaaactgaagactgtgttcctttgtaaaggaaagttgaataataatggacagattataatcttgtgcaacataaccaatgagcattgggtagagacctgaatccttactgtccagcccataagccctgctaaaaagactatggtgtttatattcctattgtaaaaatcacaagaacaagtacaaataatcaataataagtttggtcaaaggaccaggaatgattataacaagtgtctcaaatgagttgattattaaaaccagaagaaacaaattacaaataacccacatgaggtgaagaaggagttaaacactcagatatttgtacagcataattttctgtagggttacttgttatctgttacagttatagtctgcatgggctaaaccctagtttgattctgagcataggaataaagtgattgcaggagagaaagacagaggagctagagagagagagagagagagagagtttgctgtgatacaatgtggatataaaacacttgctaacaagaagatgcactaaacacttttttaaaaaattgttttattagttcaagttagggaacaaacttgtttcacatgtaagtcccttacaatgtccaccaaattccaccaaatcttcctgtgctgctgggcctgggcccttccccatgtgttcagggccagagtgtatccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctggagtgcagaggcctccttattgacatccatgttcaggggtctggatcagtcctgtactggcctccaagacagcatctgaggttgatgtgctctcccttgttcatgccaactatttctgtagatttatccaacctggtacagaccccttcactcttcattcctcccctctcttcaactaaatttcagatttcagctcagtgtatatctgtggatatctgtctgtgcttccattagccactggatgagggttctaggattgcataaagagtagtcatcaatcttttttatgggaagggcttttaggttatcctctccaccattgcctggattgtcagatcgtgtcatccttgtaggtctctggagacctccctagttccagatttcttcttggacctatagtggctccctctaatatggtatctctcatcctgctctctctcctctattcttccctcaactgaatatttctgctcctccatttcctctcctcttctcttgctcttattgtggtttctccctctcccctaccctcatgctcgcaattagcttaggagttcatgccacttcccattcctgtggtccatttatcccttagagtccttcatgtttcctagtttctttggtcaagaggattgtaggctggtaatcctttgctctatgtctaaaattcatatatatgagtgagtacataccatgtttgtctttttgtgactgggttacctcactcaggatggtttcttatagttccatccatttgccttcgaatttcaagattccattgcttttttctgctgagtcatactccattgtataaatgtaccacattttctcaatccattcttcagttgaggggcatctaggttgcttccagtttctggctattacaaacaatgctgctatgaacatggttgaacatatgtccttgttgtatgaacatgcactatttgcatatatacccaagagaggaatggctggatcgtgagtagactgattcccatttttctgagcaaccaccatactgatttacagagtggtcttacaagttcacactcccaccagcaatggaggagtgttccttttactccacatcatctccagcatagattgtcattggtatttttgattttagccattctgacaggtgtaaggtggtatctcatagttgttttgagttgcatttctctgatggccaaggattttgagcactttcttaagtaatatagtaacttccttagtaggtgcaatttgggagttgtgatcaatagttcttccgaatcatacatgcaagaggagaggtatcagctgtaggggaatgagatgaacaatggaccaaattcagagaagagacagaccatgtacttccataaggaaagagacaattttttgtttacttagatattatttgtctagattgcatatctccattctttttgcctttttagaagcttgagaagacattcattctttccaaataatccccagtatgtgttgattaattcatgtggattactctgtgaggaagaaaggtatgaggagagaagagagaatatcccatctgaccaatggcacaatatcttcagcatctgaagaaaaccatggaaaccaccccagtcaagcatctcctgcatggctccttccagaaacttgtcaactgtcaggagcatgcagcaagtgaagctgaaatttgtattgtgtactgacctggactggcatcttagctcatcagtaaatggggtaagtgtactagactgtcatttagttcatcagtaaatgggatgtcagacaggtatatattctcaattcactatcatctccaacaaacaataacagacagcttcatgtgggagttagtgtttagagcctgtccacagagatgcatttatgacagagcctggcatgttatagctagtctttgttcttccttctaccactgcccatggtaagagcctgctgtgcttggtgaaatgattgtcacaattcatttcacacacaatgcttttcttataaggagaacatggaaggggatggaataacttaatattcaaaatgtagagagataactaaagtttggactctctatgaaaactccacgcagactatattttcgtgcctaattaatagtgaaagacaacctcaatgaaacattgtgaaaataattatattttgaattaactggaagtttccatgcaatcacaaagtatgtttgtttctgatgtatttcaatttccttacctaaactttaatgaaactaaataaataaattcatgaaagaaaaatatccatgagaaggaacatatcttcctagggcaagatacaatctttctggaaatgaaaagaatcacattagaaattataatgtgtcccatttgttccagtagtaaacatgtttgaaacagccagagaatttccaatttctacaaaaatgttctccaggctatcatttgcatacaattgcaatgtatatgtgatatgtatagggagtaaacatttgactgtccagactggagataaaaactaaatagattacttacttacatactggtcacattatcaagtagataaatgaatcacagcttatatattttaagagtttctatgttggtaccttgcatagttatagttagttactttaacaatagtgaggctgtacttgaatctattattttcccaggaggctttcctttcacctcttggtacagaatatcgagtagaacttttaaatatgtgtctgttttaacgataactaatttcacatttgtttgttgaatggattttgatacttatttaggtctaaggggtattgaccatagctaacaataaaaatttaagttatcatctttagttttgtgtgtgtgtgtgtgtgtgtgtgtgtgtgtgctcacatgttattgtgtgaatgtgtgaggttccatgacaagatgcatcatggagatcagaggacagcttcaggtgtgagtcctctccttctactttacttaaagcaggcttttgtctctgttttggttctcagaacgcatgtctagattgcccacaagcttccaggcactgtccaccttccattttgctggatcactggcattacagacaagctaaacagtgtctggctttatgtgttttctggggaactcattccaggtcctcataattttggtgcaaacactattttttttcccactgaactgtctctgcagccctttggctacatttgatggcaataaaggaatcatagctcatgctgtgtatagatgtgtctaggtctaaaataccaggtataaaatgagtttcctgtatctcattcaaattgacagcatatggataaagcaaaaatccatatgaatgggagggtgactatgctttcgtttcttaccaatgctctttaataatgtgaagtcaattttgactaggtctggaaattcacaattgttttgttgttttccctctagtttctatgcctttgtttcataccactttaatttatcctctatttatgcctaccatcaggccacttcttctccataacctcttattctcttcttgaccaattttcaccttgttttaactctttgagcatcacaaaagcagccagggaaggtgggagggacagcaccatttacttgcatttgtgtccctattcttaaaacagaacaagagttccctttcacatgtgcaaaattccactactattgatgtctagatcagaaatccacccttgcttctgtcacattaaattattttatatttcacatctctacctaaatattctccaaccctttttttgccttccctcctcaggaatattctggtaaaatttcacctctactcattgcctctaattctctcattatcactcaatacccacttctccatcccaactattttggtaagatccagggccacttttgtgttgttgagttcaacaatgctcattgcatttgccatctctggtacattatctttgtgtcactttctgagatgtttatgccatcacccagcccagaatttttttttttttgccttagtgactattaaatactccctttttcaaatttttctggtaaatcctttaattttggcaaatttcagcattatctacacttatgctatcatctctacatatgctatttaaacgatttattgtcatattaattctatagtattatcatctgatgacatagtcattgatgcaaaatatactaaaatagtaaagagcaccagaacaaataatttttattagttttctacaactttgccctcacatttttcctaaatttacaatcattactatttttttccagttgaaaataaaaaatttaaagaatctcagcagataaattcaagttcacaggtattggttttagagaacaaatctgtcttgtaaacagtggttgtcaatcttcttaatgctgcaaccctttaatacagttcctcatgttgtgttgaccctaacccatagttattttcactgatactttttaactgtaattttgctactgttatgaattgtaatgtaaatagcttatgtgcaggatatctgatatgcaaccccagtttaagggtccttcaacccccaaagggatttcaacccacagatggcaaactactgctttaaatgtggctgaccactgtttccttggtggtattgtgcctgcttttcagctcttctttttttatgggctgcacaggaatgggtaaacagatatactttccctcttatttttcatgacttttattgccacatttttctagaaatgttgatcaacacccccaaatatacaatgaaaatatcaagtcagaaacaagttagctaaatttaacttcgaataaatcaggttttcatttactttgatattgaatagggagaccatggtatttttaatggtttatttaatttagtgtgtgtgtgtgtgtgtgtgtgtgtgtgtgtgtgttaaacatttgactgtccagactggagataaaaactaaatagattacttacttaaatgcaattgtttgtatatgtaggggagggtgaacatgtgtgaaagtgccttttgaggtcaaagttatttccttctggaactggaggtggactcacagacacttgggaactacctagcatgagtgctaggaactgaacttggttcattgcaggaacattatgtgtttttaactgctgaannnnnnnnnnnnnnnnnnnnnnnnnnnnnnnnnnnnnnnnnnnnnnnnnnttagacagatgagtcaagtttctcatttatgttgagcatgtttttggattaagatttaatgaccatttgattaacattttcaaaccaatttaatgctctaagttgtctccaatgaccaactcaggaagctatcatgataaactttattttgaacataattgctaggatgatagttttgacaggccttcatgaagagggaaattagagtaatggattaagtatacatcacacttggaaagatgatactaaatgagaaaacgttttgcacaaatagataatgcacaaatatataagttaaagggtctgcacatacttaaagtgccaatcttgctgaattcccagtacatggcacacagtgtagttgtgtgaggcactttcctctcttctttgcacctatcttgcagtgtgactttagtcatctttgtgggacagaaacttagacacttctataggctcactcttcttctcctcatagcaatcttgtaccatccctcagaattgccccccttttcagtgtgctgtttttttttaacctggggtgaacctttaaatagtcatacctataataacataactttcctgagcaaacacaatattcctcaatggtctccttatcacaaaatttgtgtcataatttctttaccatacaatagtcttagcaatgtgtttaaaatgtttatgtggcagaaagagtcatacatgatgatcaaaggacaaatgaatgacatgacctttgctaaaagtctcctataatattctgaaagatgttaaataaattttggaatcataaattataactctgttaccaagaatgcaattattaagagcagaatgaaatattaaggcctaaaagaaaatcataccataatattaccagatcaggacaaacaaaagtctttatattgaaatatttatgattatttgcaaaaatagttccagaatcaatagctttaataattgcttactaaatattttacctaattagtacctgaatttctcactttaaattattgctcttgtatatttggccttgacacttattttaagggaaattatttgtactattttaagcatttttacttttatctcttttgcctcacaatattgaaatatgtagtgaaaatatcaggttttgtttagcacaggttctttaaggaaaagagttcaaattgtttttctcaagtactgttagtttaattgtttgtcaattacctgaagggcattcaggacttcatttcaattaataaaacggtacaactgataagttttattcattagtatctgccaaaactttcctattagttttagctgtgaaaggcatttttactgatatattgactattctatacagccatatcattgactttatctctgagtcttcatgactgttagactcaagtgctcttaacattttaaaagtctacctaactcagttggtgttcattgatcacaaattttgaagatgattcaatgcagtacctttagcccatgaatttattcaatgaagctacaatttttatcccagtcagtcagccaagtactggatgttatgctcttgtaagaggatcatagtgatcatatattaacctctcagtgagattgggcaagtaattttagtaacatattgtatcatgccagatgaagaagaaagaatgagagtagctagaaaaaaaatttaaggtagcaactatctaggtagtgcttgggacatccctctggtaaaccactgtgtagattttcttggaaagataatgcatcatgtgaccaggtctataattctacatatacatggtacaaataatgactcaaattttataagatataaataatgttgtattctcttgtcattgttttagcaaacaagttacactgctgctgaatttattaaaatataaatgtgtttattttttaacccactatagtactaattcatattaatatcctactatccttctttaaatgttacctagataaagatattattctttccatgctttgtttataaatagcaaacatttctaagccagacaaccccagaaggtaaactttcatctctattgaagtacaaaaatacaattattttcaaaaaggatttaatatacagaggtatatttaatggactaaatacatctttgaaaacaaagatttcttggggattttggatcttgccagaattggaactgtctgcattacaaaatttatgggacaccaaacttctgagtgattaagattactaatattttttccacatatttcattccaaaccaagcattggattctttaacaaagaatagttcgatgtaacaaatttttctgttttgtgataggctgcaacaatactgctggttgcactactctaaactgataaaatattccctagtaatgtatagtggagaacaaaaagcaaaatgtctaagcattaatatttaccatattagctggctcaatgtggaagagaagttcatttgggaaattatttgttgggaaccacagtctgaacacagtcttgaaaccaaaaggaccttaaaattctcaggttgacccacatttgaaaatgcttgctatcaaacatcaatgacccattagaaacttgattcctatcattttgtagacagggccactgctgtacatctctactgaggacacaatggttttgggatagatttcattccatgtcagtacagaagaatgtattagatctaaattctacttgtaggtgatagcaagctagcctgaagttttccatttatcagggttacctattcaacatgcaaactcacaattaacaggagattctggtgacttacatatacatcagtgtctgagaacatctgatgaaaacttcatttctctccccatttctcatcctctagtttatatttatgttgatttttactctcagtttatatttgatgcctggttcaattattgcttactttgttattcttgttcaataattttctttttttattcatacttttttatttgaattagaaacaagattgttttacatgacaatcccagttccctctccctcctgtcctccccgaccattcctcccccccaactaaaactctacctagcaattctttcctttttaaaatgtggaacatttttatttctgttctcttggaaacctttccttatatcctcttagtaaaagctttttttctttattttttatggattcttgtaagtttatttttttaaatttcattttacattccaattgcatttctctctcccacccctccttgccttttccccagattattccccatccattcctcccacccagtaagggcttccattggggattgataaagcctggcccactaagctgaagtagggtgatgatggggaatgtacttctgtgtatgtttatcttattgattgttgaataaaattctgtttggtcaatgaggcagaaagttagttgggactaggaatcaaagaggattccgggaaatgtagtagagaagtggtgatccaggcagtaagtgacatagcaagaagactcatatttaagcaaggagaaacaggaagtgtccttttatcccttcgcttcctccagtggtgccatgtgagccaccagcaagaaagggcaccagaggaaggcacctctataagataaatcttataaaatatatggatttatgataccaaagactgagctaacagatgagaatcctagtcattggccaagcagcatttgtacctaatagatgtctatgtattattttgtccatccatgtggtgggaagaactccaactgctgttggagactgaacatgtggcagtagggctcaggggttggggagctttggccagaagacttatgataacaggataaagtccctccacactgcattaaggttgagcatggcatccaaccacagggaatgggctccaaccaaatagctcatgtcccagagctagatacttgtcctacagtcagggacccctcaggtagacccagatatacaattgtgtcccacaggcaggggccctagttctgtccaatggaggctccataggtgtaggtctaggaactataagttcccagagtttggttcagctatctctatatttctccttcatgatcttgactttccttgctcacatattcccttctccttctgttcaactgggttcttagagctctgcctggtgattggttgtggatctctgcatctgtttccctcaattacctgataaaggttctatgatgacagttgtaatattcaccagtctgattacaggggatgatagttcaggtactatctccactattgctaggagtcttaacagggttcatccttatggggtcctgagagtttgcctagcaccaggtttctcctaaaccccataatggttggctctattgagatatttctttcactgttgtcccactctgtccctctcccaaacttgaccatcctgttaccttatgtccttagtaatttcttgacctttatgggttttcaaataaaacacatattactaaagattcaaaactaacactaaaagattagaaaaaatgtgatgcttgctagtaaacatttttttcacatcactagagatgacagagaaataggtcaacttcaactatgattaaattctatacatctatgttgggggatgtccttctgtatgttgtgaatgtaaatgtccttattggttgatgaacaaagctgttttggccaatggacatgtaggatttaaccagttgagaaattcaaacagggatagagaaaggtaataggtggagtcagagagaagccatgtagctgctgaggaaacaagagccctaggcatcacaggtaagccaataccatggagatacacagatgaatagaaatgggttagtaattaagagagagctagtcaataataagccagatcaataggccaaacattttataattaatataagcctcagtgtgtttatttgggactgaacagctgtaggagtgggcagaacagaaactttcatctatacatgaattgtcaatttatttctcaaaatgataggactgaaatttttgttacttttatacttttgttagtttcatagatgtatacactatattgtctccatgttcaccacgagagcctatttcccatttttattgaaatttgatttgttctattggaatgatacctggaaacatatttacaagggtgagggcagattttaatatcaaatgatagtacaaagtaagtagctatagttaaataaattgagccttgagtatgatcaatagattgcttaaacttgtataattaagaaagaatcaaacatgtaaagagatactttttctatatttccattgtatattttaaaaagatatcctgctgttccaatacaatcaatcaagatgtttaggttttagacatagcatattatcaatcaccaagatgtatttgtgggataattttctcctggaagtaattttccacctctcatggcctcctctttagttcccaagcatctgccatcctgactcctacatagtgcacacagagaaaatctagatctatgatatgtatatctgagtcttgatcacttcacatgtataggatttttcagttcaattaatttccctgccattttatgattcaattttttatggctgaataaaaatataagtaccactgtatccatatattttccactactaatgggcatgcaggatgattctaattccataagtagaggagcaataagcacatattaccagatactttgtagttgtacatggattcctttggtgaacagtggtgatatggttagttcatatagacactttctggttttcatatcaatttagatattatgtgacattggctcagaaggtctttgacatccaagaatgttttatccaagcttttactccctagaacatgtttctgagagataaaagtaaatgagtcagttacattttaaattgctacagatattagctcatttatctgagtgaacattgataattaaattaaacctatagttatgaaattttgattaaacactagaaaaaggcaagaagttatttgatatttaagcaaaaatcatagtccattactgcttttagaaatggattctggagaaattactagccttaaatctttgtctctatgaggaggactgtatttctattaaacacaaataaaactttaagaggtggaatttttgtaattgcttgataggtttatgttgtgaaatgtaagcgataatggttactaagttttctggaaatatttatcctttttgctctttcaaaatataaaatccatccttaataactaaatgtccctttatcctataacatgtcttccaaaattgtctttaaatgttttgattttaaaatattaatatgccatttgctcacaaaattatttatcataatttttaaaaatccaaaatcttgatttatggggcaatatctactataatttctttcttccaagactttattcagtaagacatttgtcttgagaaatataggcacacctctgtacacagctgtatgctacagaaatgcattctgatgaaagaaagacaatacacataaattatttggcaagaaaacattccattaactataggcagctgaccttcactgtgtgcagaatgatttataatggaggctgcttttgcaaaataaattgtgtgagaggcaacagttgtctggatcctggcagtggttttgagtcattccataattgagcattagatttatgaagtcaataacatcaacaatgtattctgattttatcttaattgtatgcaattagacttacgttgcttttcacaaaattaaagatctgaagcatggcaacatcaaagacaccaatgtactttgctttgctagatgaaacaaattgagcttttaaatgctttggggatttccacatatttatggagacaaatgctatgaagtgttgatgttctcttgatttttatcttctcattgacaagtgaaaaaaataccactttaaagttaagtttcatatgctgattcatttaacagtgtagtttgagtacacctaagtgccaagtaccagtttaggctatggatataactgtggtaaatccaacacacaaatatgaagtagcatagactttctgggcattgatagaggatagaataaaatttaaattaatattcttaatacaatgcaaaatgtcattatacaatggtcagttttatctatcaccttgataaaatctgtaattacctggcaagaaagcctcaattagggttggacaggcatgtctttgggggatgttcttgattacactaattgaaataaatgatgtaggtaacatcgtttcacaaacaggtgatcttggattgtataagtagagaaactaagatgagccaaagcatgcatacaataatatattcttctcagccactgatatggatgtgatgtgaccagatgcttcagcctcctgctgctttggcttccttgcagagttggactgtagtctagagttgcaagataagtcatttctttcctaagttccttggttggaatattttatcacaacagaaaagaaactaagacaacacatacaaaattacatatatatatatatatatatatgcatatatatatgcatatatatcttattttataaaaaaatataaatatattttatgtatggttttgctttggaacttgatggtcagtgtttggcagaagtttctatcctgcctgttcctgcaaccctttcatcccagataaacacacaaaggcttatattatttataaactgcttgactgatggcttacacttcttattggctagttgtctcttaattattaacacatttctattaatctatgtatctctatgtggtcttagtttgccagagaacgcctagacatcctatcttcctggtagctacatgacatctcctcactctgcctactacctttctgtatccttgtttgaatatcctgcctagttgaaacatgcttgtccattggctgaaacagctttattgataaaccagtaagagaaacacatacagcatacagaaggacatccccatcttctcctcttttctgtctaaataaaaaggaaggttttaatggttacatagtaaaattatatataacaaatagtaatcaagcaagaactgttgcaaactatatttagtctgttaacaattggtaaaacttaaagaattgttctatcatctattgttgtgacccaatatgtctcagccttagtctatgaggttcggcctgagtgggggtgtgtggacctggaagctcctagcaacccagtggcaataaagaccaaacacagacatcttgtcatcttcagagagctctcagttccatgttgtagaactagagtcatttctttattagccatctttctgctgtttcttaacagtcctgtcatgaccatgagggaaccatctctctttgttctctctgctctggtcacttgcccctaactcctaaccttcagtcctgacaagttactcacacacctcacctcttggcccaggtgcaggcctattagatgcttagacccacagagatgcaaataggaggcatattaccctgaggtcatggtaaacaatagtagccttactggcattaacaatacaatagtgggctggagcttttttgtgttcctgtttagtgaaaccaaaggctggatctcaaaatattccatagcataaatatttgggtcccccacaatctttcctatctttttgagtctaaagtttcatatgtaatttatattttatcataactaaggaaaaccataaccatatcagttttcaactccatcaaagacctcagagggatactatagaagctctagagttgacagccagttacccaaagttcctctataatgttggggaatccctcttcagcttataggcccagaatatttggcagactttttgatgaaacagcaaccttgaaggactatttgtcccttggaaagttcagcagtcacttttctttgtaacctgcttgtcctgtttggacagcaagctgtcaatcagtccaagcaatagcagtttcatgtccaaatggttatcagtgccatgttgaagttaaactccacaatgaatttctttgatgcccatcttcctgtctaacataattggtgttgcaaggagaaattgtatctcattgttatgaaaaaccctaataaacctttttaaatgccatattttgtaagtctatggaatgatttgaataaaacctatccatctgaaatatatctttgtatttctagaaaacctaacataactataaggtttgactataatctgtatttaattatacattacattttttaaaaagatttatttatttatttatcatgtatacagtgcatgccagaagagggcacctgatcacattacaaatggttgtgagataccatgtggtttctgggaattgaactcagaacctctggaagaacagtcagtgctcttaacccctgagccatctctcaagccattaattatacattacattttaaaatgagctatataaacccaataacaaaattgtccttaaatttgtaataataaatcaatatccataccaatgtatacattcctatatcatattccctttatttctttagaaagagagtgactgtggtcactaaccatttataaaaaatcctgtttaaattaaaacaaacatttataaactatatttgggaatttgggcatagttctctctatactgcttcctgatgtttgggggtgctgtcaataccatggtgatccagagaaaaccaagaaccatggccaaagcctgactgtaatagtctgtgaggccgtgtcatttcagctgtttcacctaagccactgcttcaggatgtcttgtttgattgaactgcagcttttcatcttctgtggaatcaaaagcagaatctcttttccaaagtaacctgtccttaaacttaaattttggagtgagtgcattttaaaaatacattggttggattaatccagcagcatttataatcaaatgtcttttagcagctgttgctccttcctcagcagtcaatttaaggagaacataataatttatccatactttattttccatcattatgtggccttttttattactctatttttttatttctgtttttttttttcttttcttagacaggatttttctgtatatctttggctctcctggaaatcactgtgtagacaaggcttgccttgtactcacagtgatctgcctgcctctccctcctgagtgcaagaattagagtgttccactgcactcagttattctatttttaaggacattctctatcctttttctatcctctcccaagtatacatatatttttaggcacccaataaaccatttagaattttctaccctctgaatcagcctttattgtatatctctaacttttttcagacacacaagtcattaatctgctaagcagtatggctatgtttaagcatcagctggccacagcttattccttggcctcctgagagtctagcttcatggcagaggtactggtgggagcaatgtttatcaccactattcttcagagtttttaggttctcttgtgtttagaatgcccaggtattaagtgaaaattcttgtcaaaagtgagggtaccacatgttgacagaagtttctgtcctgccaagtcctgtagctatttagtcccaaataaacatacagaggcttatattaattataaactacttggatgatggcttagggttcttatcggctaactctctcttagttactaagctatttctattaatctatgtatcttcatgtgtccttggcttaccagagaatcctcagatgtctttcctttaggtagctacattacatctctctcattccacccattacctttttctacctctgtttggatttccagccaggctaaatcctgcctttccattggccagaacagctttattcatgaaacaataagaaaaacatatactcatggcatacaaaaggaaatctcccatcaaaggagaaagggtattaaactgctgtatgctggagggaaatcaggtttctgttagaggtgggagatttacaattgtaaagagggaatgtaattaagatatttttttattctattgaaagcaatgagagcattttgaaggaagaggaacaaagttcttcctgatcaaaaaggatttagtgttctacagagattaaaaccatgattaacgatgaaggataagatggtggctcaatataacagcattctcagcaaaatgatagcaattttacttgaagatgtaggtccaggttttgacttatctgtctatgtaattgagtctaaactggtgctttgcacatatggccttcaaagtataattgctacatggatgaacaaatcaatgaaaatttaactttaagcagtatacctttgtctatttctcaactatgagaagattaaaattagaagaatatgaacactttatagtagtatttatctctacaaaatacataactgcttgtgacttttagagattattgttttaaagattattattatttcattttcacttactttttataaataagtgatcaagtttttaaattactctgtagtataaatattagggagagcaaaagaaattattataaaaagtacagtgggaatgaaattaatgaaattgactatttgctgagaagatgcctggaacaatataaagttctattaaatttaattgatgatcattctactcattatgttcttgaccctactttggactttaggatttgttctctcaataaaagttactcctgataactatgcagaggagtttgaagatgattccatgtagaagtagtattgagatgtatacaggcagaggaattcatggtattgtctatcagattttatttgcaacacagttactattaggaaacattatttttgagtaagtatacatctgattgaagatgaccttgttgaatattcaccctttccctaggtagaactgtagtgtggaatgcccatagtattctctctatcttgtaaatcctctgggctaacatgattaagctccttatctgataccattttgttcactactcaccctctactttgtactgttttcttgtttgacaatgtgctgagatcaggccatctaggctcagccatggcagttgtgtgtagtagtgagcctggagccttactgcagtttagtcttggttcaataaatggtttcaaagaaaacactagagttagtgctcttctctatgtattgagtatgtggagaagctgcctggaagtgataaggagcagaaggggtctcacttggtgtcctcatactctcattaaatctgttaaatgtggttctattggctgaccctagaatcttttgaaatccattctgcactgcatttacatgaattacaccttttacctcctatctgtgtccctaaagtaaataaagagattactctttaaagggaaaaaagttttctagaaacatgtatggatgtgtactttaatattttaaaatttaaatttccactaaaaatagttgaaaataaattcaatttttatatactttaaaatgacaagtagattcttatttgtgtcatattgtaacatagaagcaagtagctctggtttctcagtacacattaaaattaaaaattaaaactttgaatattttaaagtaattttttaataacattatgcaacaatttcattttgcctaaaagcaaaaaatatatactatcagtctttttgttttagcattatcccttactttttgtacaaaaatgtgtcagatattttcaagagtatttagaaaaatgctttcaaaataaatgtgatcggagagttagatttgtctttactgaagtttctcttcattttcttttgtttatttaagttttaaaatacaaagactgttttatgagtcatcttcataaacagacctattattatcattagcgactgcatttaagacattctcccgatcacactcttcactatttgtaacataaattctatgcataccttccaaatcaccaccctccagagaatattctgcatctctgtctgcctcagagttctgctcaatctgcagaagcacttatgctaacccaactattagcacctgccgaaatacctctccatcagtcatcaatcatcagcaatcaggcagctacttgataattagttgagagggggaaaaacacttcaaagaactaaaaatattttgcacagtgactttgtgcataaaataattattttccctctattaatctccttcacatcactgaacaacatggaaacttaagaaatattgtgaacaagtgctggtcccatttagggcatgctatgctagtttattcatcactgccatgagagatatgcctgactcatgcaggcaaacctaagagtgatacatgtaatgtcattgtcattatgtatatttaaatgcatatatggatatgctttactaatatatatttcctttatcaccatttttcataaaagatgttcataaaaaatactcatagaaaacaggtaagatctattattttttcagggctgtgaagcttcctaacttggtgacacatatacattcaatgaacccttacgcatgccttaggaagaaggaatagaatactgcttgtccctccagataatgaatacatctcaggcagagaggaagtgactgaaaacaattgaaaattttcattgcagtgaatctaggatattccagctttagatttgaagttcttgagcacaggataggcaaggtacaaaatatgtgaaagtaggacagccagcaagcaagctgattggacactcagtgggtctcatggatattcatgggaaaggagactttctcaaacctccctaaggcatcacattggaggtaccttgccttaataaaatagcaataataatgtaaaagatagccattataaggtcatagtgattactttttattactttataaaagttgccacagttctttacagatccacagttttttacagatcatgttaaagtgccaggtgaaatgtcatggcagatttctcgtaagaacaacaaacttagtacctctaaatcaacttggaataattctcaaaaactgggagaaatattttcagcatggcagtatggaaattgttttcaatcacccatgtttgtgcttatgtctatgtattcctaattgcaagtttccatccctacacaataaattacacacagtcctatttccagaacaacagaaatacatacaaagttggagtgaagaccttatgcttgattttgcttcagttttacttgcaattttaattgctaatgcacagtacatatatgggatctatccattctggatttagcaaatgttgtacctattacatctagtgtatatacacacaaacaatatataatgattatctactcttaattgccttggcctaatgtatacaaatagctactctaaggttttaatcaacttaacttgccaagcagatgtgctggtctgtctcctactactatttgtttcttcatcacagtatcttttacgcagagaagacaacagaaagctttgaaaatatatacatgtatttcatatgcatatttcatgaattttctattcctgcagttagaacttcacagactaatgattctattttgaaaaaaaatatgcacagtttttggcatttatttagtgtccagttacattcttttatttatagttaatcaaaaatgttttaataaattaaaacaaataaagtgaaatactgttataagtattaacaaattaagaagcctaatgataccattccacactgacatttttttcttgaattagcatttatttttagaggaaacttttgaaaataaaaacattttaaagatttagacttagaagagtttctaagtagaagctatttccaaaaccaagtctgcaaaatggaaagtattgatcttttttattttgtgttctcagataggaatccttgtatatttttatcctgaattggtctgcaattacactgatgcagatgctaaatctcttccctgacatgcttacacagagagaagatgccagttcagatcttgatgaaacactgaaggaaggacagtgttaagggataagaaaaaggaggagagaatcagaaagagcatgatgccttccaagccacatatacttaattttcttcctgatttctttaaaaatgccagaagacaaaaggcaatgtacatgctttatgaattgtaacaagatatgtcaagtataattcattgagcatccaaatccctacctcatttattttgaagtttgcttaaagatccaacatggttgataagctgaacaaagtagaaaacttagaaagcaacagtaaaatagaaaataccaaaaaagatgcatagaaagtgtgcaaagaaaagctaagattaagatacaaaaaaggcacaaaatatttcaagacatagctggtcccagggaaacaaaatcctgttattgagaacacaccatgtacatataattgagcctgcagggtcatgttcatgcatgcattgtaagaatcatgcagtagaatcaagcaaaggtgctgaagacagtgagtacattagaggtcatatttcatgtaattgtttaaaagaaagtggaaaataatctagcgagtcatattttctttgagggacttgagattgacatgaaaactaaaagatggagacccaaactatcccttgcacttatataaaaagaaatggaggcacaaagctaatttcaatccagtggatatatccatctaactacagaaaatctgtcttatgtaacttaatgggtttagttccagaaagtacaaactagtctgagtcaatttggagaaaccacaatcttgatgtttctcaaaacacaaaaggtcatgttcagagtccttgatatttagtaagaggaaactgtccatgagaagagatttggaagccagctttgcaggttgatcattaaagacgttgtcctcacatgcagagccaagatcacctaaacagtctagaaacttgtccttctcttatcaacagcaacatagctgatactttctcagctgagattttgaaattatggtttatgttcactgtgaaaaaaacaaaaaccagcaaaataaagcaaaaacaactagtgcatccaaagacaggatttcaagcctttcctacaaaatgtctgaattatcctcatttgcacaattataaattagaaccaatgatttttaatttttagaaagtatttgagattgtaatataattacatttattccttctctttccttctccacatccttccataatgctacccacacttcttcaattgcatagcatctttttccatttatagttattacatgcatatatgtaaatgcacatatgttcctaagtatgaactgctctgtatatatgttatttacttgtatttttcagggctgaccattttgtactgtacaataaatttgtatgcttctgtccttatggaagactacctctctagacctcagatttactctgttgcctgtagttctttttgttgtgttgaggcatcatgggcttcccacagtccactttggcatgtccattagttttgtgattgtttagttgacatttgagcagtcatgttggtgagactttacaggtattgcttctgaaattactaggagacacaatctcaagcaagctcctcaatcctctttgactcttaacaatctttccatccccttttcaacaaggttccccgaaccttgcgttagctgagtaccttaggtgagagtaggctctaatactgctttttcatcggttgtagttttctgtaatagtctccatctgttgaaaaaaaaagtttcttgatgaggggagaagactgttcttatctatgggattagggcaaatttttaaagattgtcatggggattatgaaggtttaataaaattagaagttttagatactccaccagtaatcataacttcattagcactgtgtagttagctagatttctattactaagcatggtttccctgctatgtaacaataagtctttctgccaaactgtccataagcaaatcttaagtctaatcagagatctcatgttttacagtttatttatacatataggataaagtattgagctggactgcattcagtattacatttactttccattctatattccacaatgttaactttagcctgtaattttagaattaggcattagttctaatatagtttccaaatgtcaggtgagaggtatacaaataaatatgtttgaaggtaaagaaaattcaagcataatgttatgtactgaatggctgattagtaaacttacttgatgatacctgtttctatctcatacaaatgtggaggcacagacatttcaaaccattaacctctgcatttaagatgaaatatggaatataattggctaatttcattaaaaatatatcttttattaataggcattctagctattaaattgtaaagtaaacttgcacttttcctagaatttccatgtcacataaatacaaatgtgttggaagtgggcaaattttgtatttgtctagcttaagcatcgaagtacaacatgtattatattgaacaacatatctagatagtttaagattagtctaggattgaatatactcactcatcttctttttttcaatgtttatgtaattttagaaatggcttagttgtgctggtttggagtcatatcatccaatcatcatttgtatcctaaaaggctcatttatgtatgtgggaattggttccacataaatattttaaatagtccaatcttgtaactaaaatctgcattataccttgttctaaattggctttacatacattattcatatattcactccagcaaatctgtgagatggatattaatagtcttttcacattagatgctaaaacattgtatcagaatggttttaagagactttctcagtactaggtagagaggcaaaggcttatcctcaaatgatgtaaggttaagtatcatgtaatttccactatattatgctgtttgatgctatgtttttttcctacaatttatgataccttcatagtttgaaaatcttgtttcatgtaatagctaatttatgctaaagaagttatttaatctctttagatcttagtttacttatctataacataaaagtgttatgaatagtagtatcttcctaaagggctgactacatacttttgagattccttcacaaaaatgcaagtgctttttaataaataagaaaacattcaattaaaaaagctgaaatgttatatagtctctcttgacttaagattttcttattctcatcatttcaagtaaaatcaaattaaatatgatcacaaattggataacttgtcattatattttaaattagcaactttaggttcatatctgaacatttatcttgcatatagaatcattgatattaatacttatttgtaactcatacgttttgctgacttaaatagtcagaatattgtgtaaaactaactcaattgtttacatgtttcctcttgacaaacatagtctaccaatactttctacatgctactcatgaatgaaaaacctaaaggaagggactcctggcttattctggctttcccttttttcttatgacacatgtgtagtgaacatgtttgataaatataggggtaatatgaagatgaagggatagtgaggtttctctgacaattcacaagtcttaacctgtaaattgccttctctctgcactggaaacagttttgggttttaagaaggcatagccttttgtaggtatcagcactaccacttatttttcagtggtagtacactttgtaattgctctaagtctcggaaagtcttcttgacatttgacacccactaggatgcactattcttgggcattgggaatgctaaatgactttgaggtggtggactggagcaagcacattacatatatcttttctgtgcaagaacttgcatcaccattttgttaaataacactggtagcattacacagacaatggaaatcattaatgcaagtacaactctcctaagctggaatccttggtctactgcaaaggccacaatttcacaagcctggccttggctgccttgaggtgttgggatagaatcacacacatgggttacttagaagatttcttttttcgttcttagttggcacttaacgaatgctaacctattattatataaacaagtgtttgcttttcttctattgtataaaatgactttaagttggtgaatttatattaggggaggatctcaggtaacataagagatgtgtgaatgatgtaggtatgagtcaatgaagaacatagacaaagaatgtgaagtggcataataggactgcaagagaagcactggatattttacgaccttttaggccggcaatcccagcatgttggaggaggaggcaggataaccataattttgaggccacctttgcctatataacaaagtcgagagaagccatgcttataggaaaccctatgcaaatataaaacaaagcaaagccaaagaggatattcaaaacacagtaaaaaattggagttagacaaatacacgacttttgttatagactgcaaaattgcaactgtttctgtgcatactgatggtttgtaataattacacatgaccaaggttttttctgcactactcctgacatcattgtgattatatttaaagttcactagcagtttaaccagcacaccctagaatgagctgaaggaagtgagggcaacttaaaacaaattaaaaaaaacaaaagcatatcagtatctaatttattttcacctatattaggtaatagtgtagtaggtttagagagacaaacaataagctgatcccattttgttctcaacactttatacagtgctaccgtcctgaatggcatccttggtgccatcctcagggctttttctgtaaaaagcaatttaggaaaaagtgatacagtgaaatgcttattcatataccacaaataatatcaactttttggaaaatacagacataaaaacttgatttcctatatttttgtgtggtcttttaaccattcctacagtaagggaaagaaaacattaatgaatgggaagatttggttttcttatgctcattctgaaattaggaggatttttatggtgtttatttctttacattcacctgggctgttgctttcttttacacacatgcctctgttttggtattctatgcagggcacttccatctgatttgatttctctctggctctcacacaatcaggtaatgttctcattttcaaatgctaatgttcagctttatatagcagttagttgaaaacccatgacaattacatttcttgtgtggtaaatattttagtatttttaaagagcttttatcttaccattaaataaaccatctgatcagatgcagaagcacagtaatttaaacccattttgcttctctgaatttcttattttatttgtgggctattctaaaatttacccacctgaaaatcctaacctaatttatcaatgaattaaaataatgcatgttttacatacttagtatttcacatatatttcaaagttgtaactctggaaaatgtttctttctttgataagaattgtcttctgaaggagtagtttgaagatttaatacagacatctcttagccctcttctccatatcacaacatcctgaaaagtaaaaattaggtgatcaaagaaggcattggttaccctggaattaaagttatgaaatgttgtgagccaccttgagtgtgcttgcaatcatgtcctgatcttcttctagaacagtgtgtatttttattaatttttaaatttgtattaaaaacaatctaatttttacataccaatcccagtttcctcttcctcccatctccaaatctcacctttcatccactcctcaaaatgagtgaggtctacaatgggggaatgatcataatctctcacatcatttggggcaggactgaggcccttctcctgtgtttaggctgagagagtatccctttataggctttttggagcccattccagcactaaggaaaaatactggtttcactactattagccccatagactgtccaggtcccccaactgacacccatgttcagggttcatggatcaatcttatggaggttccccagctgtcagtctggagttcgtgagattccaattgctcaggtcagcagcttctgtggtttctccagcatggtcttgacccctttgttcattactcctccctctctacaactggatttcgggagaccacttcttgaacataagaccaacaacacatgtactgagaccaataattaataaatgggacctcctgaaactgagaagcttctgttatacaaaggacacagtcaacaagtcaaaatagcagattacagaaggtgaaaagatcttcaccaatcccacatcttatagagaattcatctccaacatatacaaagaactcaagaaactagtcacaaaacacaaaataatctgattaaaactggggtacagatctaaatagagaatttttaactgaggaatctcaaatgcccaaaaggcactttaggaattgatcaaaatccttagccatcagggaaatgcaaatcaaaacaactctgatataacatcttacacatgttacaatggctaaaataaaaagcaccaatgacagttttattatggagagcacatgaagaatggcgaacacttctccattgctggtgggagtgtgaacttgcacagccactttggaaatcagtatggcagtttctcaggaaaatggtaaaaatacacctcaagacccatcaattctactcttaggtatataccacatggacatctgttcatccatgttcatagcagcaatatttgtaatagccattacatattgttaactactgggtcatctatccagctcagtaatgaaaatttgaaaatatttactttgggatatatatatatatatatatatatatatatatatatatatattatattggcacacatttgtacatatgtaaataaattaaatgtattctttctaaaaataatcctttaataagaaaaagtatttttccttgcaagtcagaaaaattgttaaaatagtaatcatctctataagaataaaataaacagttctgtattcccaaatgagttttaaaattgaataatgatctttttatcttatggattgctttaatatttttactggcattttgatttttttcttttatattatttaaaattattttaaagttaaatatctttcgccatatactttccctcccgcaaattcatccagatcctcttctcttccctacatgaacaactttaagtttttttgtcattgttttgtttttggatttgccaagagattatttttttattagttcaaattagaaacaaggctgattcacatgtcaatcccttctccctctgccttatatgccattttagagccctcatccagtggctgatggaagcagaggcagacacccacagctaaacactgaactgaattctggaacccagttaaagatagggaggaatgaagagcaagaaggtgaccaggctggtgaaacccacagaaacattagacctgaaaaaagggggagtgtatggaccctagactgatatcttggaggccatgattggactgatccagacccctgaatgtggatgtcaatgaggaggcctagcactctatggggcccctggtagtggatcattatttatccctggcataagaagggactttgttagcacatcccacatggagggatgctctctcagcctggacacatgggggagggcctaggccctgcccaggatgatatgacagactttgggattggctttaaattatattcaccatggacataaagttaaacaaaagaaagatatttttggggtattaaattagttttcaagccctacgtacataagtcagtcttatagattcataaacttgtgccagtattcagttaaactaatgataatgaggatgctggtagaccattcctacttaattaggcttacagccctgatggcctatttgggagtttgcatactggcatgtttgtttggcaaaaagagatatgagatgcagccaaggcttttcatacacgtgaaaatggcatctgtattcaggatctctgtgcagtctatggcatattgctgggatagaaaaaagaacaaggttaaatgtctttatttcatattgcaataacaatgagctaaacaaaatgtctaagtatatgttacaatgacatcattagaacaattaccaaaaatacaagttactacattttgaatgaaatgtttacctgtatgcctgattggaaatgtatgttgatttttgtatcccaccctgaattttagaaatgtagtcagtatcttaaactcttgattatcttacagttactatatttctgtattccattgattttaagtctatttttctggaatggtttagtgtgatctgggcagtgggaaggaatttactccagaaaatagttattgtttacatataggaagtcagcaagaaaaggggaacaaatcctctacagagtatatcctagatacttatgtatgcttctctcctcttgtccatgaatttgtccagatatattattttataaagatcacagacattcatgtgtcctaaacccactttcatcactctcctcataaaatctgagcagctccttgcatttttggagttagcacaatagttaactatcacagatttagcctttggagctttgggatgtctacagagatttacttgctgttggaatttgtaggagagtaaaagaaaaatccccccatctttcataaagttttgttggaatgtgcacctgtaaaaaagattaaaagaacaggaaaattaagcataataattgatttggcatatctacaacctggtatgattagttctcaaagacattgcatttagttttagtgcagagagcacctttggtgaagaaaagtaaaatacaagaccaaatggagaagtaaagggacccaggctccaggggtaataacttgtactatccctggacaagtgagtcatagagggagacataaaggctagctagtaaaacttttgaatttgatgctaactccaagcctatatgtgaacattaaaagtataattatttatttatttttctttgatgtttttatttgaatagaaataagattgttttacatgtcaatcccagtttactctagctcccctatttccctaccaccccctccccaactaaaatcttacctatcacatatcctttctgctactcagggagggtgaggccttccataggggttcatcagagtctaacatatcttttgggatagggcctagtcccacccccgtgtgtcttggctcagggagtatccctctatgtggaatggactcccaaagttcacacctatgttagggataattactcaactactacaggaggttctgtagatttctgaggtctcctcactgaaaccaacgttcatggtgtctggatcagtcccatgctggtatcccagctattagtctggggaccaagagctccctgttgttcagatcagctgtttctgtgggtttcaccagcctggtctggacccctttgctcaccactcattcttctctgcaactggattccagttgagttcagtgattagttgtgggtgtctgcttctacttccaccagctgctgcatgaaggctatcaggtggcatgtaaatcagtcatcaatcacattatcaggggaaggcatttaaagtagcctctcctctgttgtttagattgttaactggtgtcatctttgtacctctccagacatttctctagtgcttgatttctttgtaaacctaaaatgtctccctctattgtgaggttgaatctggggaagaatagaagaaaataagaaaggagataccataataaaattatatttaaatttattctttgttaaatgaatacatgtatacaatgaattatgatcctagtcacacctccatttataatcagttttcctccatccatagcattttccctccaaaattaaagaccttttaaaaagatcccattttaacatctgattgtgtccacttactgcttgctatatgcacatggttatttagtcatccattggagtgtgagaaatctgaaagttgccaaaatcttgaaaaaaaaatggattcttcattaaatcatgtcccataaactgccaataacacctcatctgggagtaagtccttgtgaactcttctgtaatccatggaagactattgatttgttaaatttatgtaggtcttgtgggggttaccaaagctgctatgtgttcatgagcagccaacatgtcatatccacaaaatagcatttcacatatctcttcttcattctcaggctcttacatcttttccacccctgcttcctatcttttgaaatagtctctgagccatgagaaatggttaatatagatttgacattcaggacagagcactggaacttatgtatgtatatgagtcactttgactagttgtgtgctccaacaactaccagcaaatattaagtgtttaaactcttgtgtctgctagaaaaggataagaacaatttcacctttcttcctttatttatatcctgttttcaggcaagtagtctgtagacaaagatgattccttcaagtgctcatcctgactgccaccaaattaacaattcttatttcagatacacattttgcataacattttgtttccatacacactcatgaacttactctcctactctaacaatttgatcactctgacattgtttttaattatctcataattccaactctcactgttcatttatgtttacttatgcacaaagaaatttttgctgaagtagatattaagttcccaagagcacaattttttcttaattctttataaaaccttatttaaatgagaaatagatggctagatgaaacatgaaatgactgaaattcgcaatgatgatgtcattgagactaccttgtcattcaagctaatggcacttgctctgaaacacttaggtaattaatttttttgaccatctggcaaaaaatgacaagcttcctgttcattgtttcaaagctgtgaaacaaatgaatgtaagtcaaaacaaggttaaaatccttgatttttaaggcaaaaaaattaagttctttattttattaacgtgtgtgtgtgtgtgtgtgtgtgtgtgtgtgtgtgtgtgtatgtattcacatgcaataacacatatgttaatgtcagagtatgacagaatttctttctttcttttgccatgtaaattacaggaattgaaccgaaatcatcagacttggtgtaaggaagccttatctgctcaatcatcttgcctaggattcttctagtatagggtagtgaagagtaactgatagtaccacctctccaatgacaatcatgtcttactcataaaccagctctcctccctctaggttctgagtagggaatgaccatatatttattttttggaagacacttccagtacctaaggttcctcaacaatggttagagtcacagttcctacttttgctttttttcttcatataaaaatatcaccacagaatggaatggctctttaaactacccattgcttacttttgtccttctacaatacacaacatatcatgattaactaccagactataggaaacatattgtaggttaactagaactgctcatattctgattctaaaaacatgactccatttctatatcataactactaccaagtcctttaaatatgtgttattagaatgctttctatgaagtgcacatttgctccttaattgagacaagcttttataaaattctatgtgatacagttacaaacagttataaggagttataaactacactgttcatcagctgcatactctttgaaagaggcaaggatttacttcgagaacagtttaaagaaaaaggaaggggtttgttatatttaaaatgaagtatagtgatctagggacaaattagtagagctcctattggaagtagtgagtcagcaaaacatgaaagaaaatttcactataggtaaagaaattgaaagggaggcacagatgtagtaaaagcactgttttgaaacaataaaatctgtactacagagacagataattttcactttatgactatagagttacaatacatggtagcattataaaccaaaaagaaaatcaaacgttgaatcattgatggacttctatcatccctttttaatgtgaattgttttattatggggaaataatttatgaatttggttgttattgttttgactcaatcccttgttcctcctcttgctgggtatataaatttaacaattaacttctttttcaagtgttatttttttacatttttctttttaaatttatttttatttgaattaaaaataagcccgcttcacatgtcaatcacagttacctctccctcccctctctcctgcccccatcaataacccaccctatgccccctccaatacccagggaatgtgagaccctccatggggaattcgaaagtctgtcatatcatccacggcaagcctaggtcttcccctttgtgtccaggctgagagagcatccctccacctgaaatgggctcctaaagtccatccgtatgccagggataaatactgatctactgccagagactccatgggttgctgaggcctcctgacacccacactcagggagtctggattcgtcccatgctggcctcacagccatcagtctagggtacataagctcccctttgcacaggccaactgtttctgtaggtttcaccagctcagtcttaacacctttgctcttcactcctccctttctgcaactgtgttccaggaattcagttcagtatttagttgtgggggcctacctctgcttcgatcagcccgtggatgaaggttctaagatggcctgtaagataatcatcaatctcattattgggaagggcatttaaggtagcctctccactattgcttaattgccagttggtatcttccttgagatctctgaaaacctccctagtgccagatctctcctcaaacctataatggctcccaaaaattatgatatctcttatcctgctctcatctattcttcccctgactcatcccttctcctcccccatttacttctctcccctctttttctatcccaccctttctccaagttccctctccccccatgctcccgattttctcaggagatcctgtccccttccccttctcctgggtaccatgcatatctctcttagggaccaccctttttccaagcatctctggcagtgggatggtaggctagcaatcccctgctccatatctaaaatccatatatgaatgagtacatgccttggtttgtcttctgacgggttacctcactcaggatgttttcttctagttccatccatttgcctgggaatttcaagatttcattgtttttttttttccactgaggagtacttcattgtgcaaatgtaccacattttctccatccattattaagttcaggggcatctaggttgcttccagtttctggctattacaaataatgctgctatgaacatggttgaacagatgtcctcattgtatgaatgtgcatctcttgggtatatgtctagtagtggaattgctggatcttgtggtagactgattcccattttcctgcagattctacgtattgattaccaatgtggctgtacaagttggcactcccaccagtagtggaggagtgttcgttcctctttctccacattctctcctacataaactgtcattgatgtttttgattttagccattttgacatgagtaagatgatatctcagagttttttttttaatttccctgttggctaaggattttgaacactttcttaagtgtcttacagccattttagactcctctacagagaattctctatttagttgtgtaccccactttttaattggattatttggtgtgttagagactagattcttgagttctttgtaaaattttgagattagccctctgtcgaagtggggttggtgaatatcttttcccattctgtaggctgctgttttgtcttgttgaaggtatcctttgcttgacagaggtttctcagtttcaggaggtcccagttattaatttttttatcttagtgtctgtgctacggctgttatattaaggaagcagctcctgtaccaattcaatcaaggctacttcccagtttctcttctaagaggttcagtgtggctggatttatgtggatgtctgattcatttggacttaagttttctgcatgttgatagatatggatctatttgcaatcttctacatgccagcatccacttatgccagcaccatttattaaaaatgctttcttttttccattgtatattttggcttccttgtcaaaaatcaggtgttcataggtgtatggcttaatatcagggtttttaatttgattacatttgtctacctgtctatttttatgccaatatcaagctgttttcaggactgtagctatataatacagcttgaagtcagggactgtgatgcctcctgaagttcctttattgtacacgattattttggctatcctgcattattatttgtccatataaagttgattattgttctttcaatgtctttgaagaattgtgattggattttgatggggattgcattgaatctgtagattgcttttggcaagatttccatttttactatgttgatcctacctatccaagagcatggaagatctttctattttccgccttctcctttgatttctttctttaaagacacaaagttcttgctatacaggtccatccatcatacatcaaatgggcacaaaggcacttcataaattttcagtaaaggaaagaataatatgcaagttttatttgtaaaagttacctggttgaaatttcttcattatgttgtaacatttacttaatatctctcattttttcttttgtcattttaacctagttttctgaaatgttattaaatgaagtatttacaaccattcatgctaattattgctgtttctatcacttgccaaaattactcaaattcttaagcagaaagtcactacaacaatgaaaatgagctaattcactgttgaaaatactcaatgatggacagacacaagctatatcaaattaaaaatccctgcaaattcaaatggcaaagccaaatgcagaccaggatttggagaacctgaataactcacacatcaatgacatgatgaaatttacaggcaatctatataaaacttaaaagaattaaattatcttaggaagaaacagcttcagttggtcattctttccagaaaaattcaaaatacaattcatctaaatccttgtccatgaatggtattagtattatggacaatgtatttttatttataataataaatatttataatccacacatttattcnnnnnnnnnntccacccatatattctgtaatagatgtatgtgtaaactatgtatgtttacagattcagaaacacacatatcatgaaataatccatagcaataaaaacaaataatctatttatctatccatcaacttggattaacacacaaggaagtattttgaagtgtatttccctaacagctatacaatatttattcttttttgtctaagatgctaggaaaattttttgtgaaaagaatatttgtttccaatggttgggtatgtggtggggagtaatccatgacccccaaggtgttggaaatttggtgaggtctagggataaatcttcataaagacacattagtacagtccattgtgggtggtgccatccctaggcagggctcctgggttatgtatgaaagcactctaaacaagtcaaagggagcaagccactcggcagtgttaccccaaggcttctatgtcagctgctgcccccaggttcctgccttgtttgaggtcctgtcctgactttcttcaatgatgacccatgatatggaagtataaatgaatccttttctccccaagttgttttgatcatggtgtttcatcatagagctcaaaatccaaacaagtcaatacaacttcagtgtaaaaaaggaaagagtactatcaaaatactaagtttttaaagtggctttgaagataagcatgatggaatatgtgtacagtcccaagaatgtggaggctgaggtagaaggattgcaagttcagtgttaccctggggtatatttagtgagaccatatctcaatacaagaaaaacaaagcaagacaaaaagcgacttactgttgaaatgcttattcttgaacttttcctaaaaacatgatccatagaaagcaacagactactgtatttggtatgatataccaggtatcttaaaaatactttaatatttatctttaagaataatgtccacagtaatcaatagactacaatgacagagttttctgcattctatgaatatcctgctctggattaacttcagtttgctgtagaattttattttcaagatttcaaaaatcaatacacaaaaaatttacaaaagtatcaaccagtaaaattatatgaagtcaccaattctgtcttgtacacagtgatggaaggaggcagtaagatgggaaaggataggagaaggaaagagagacagacattagtgataaccaaaaggtttgaattcaattaactccttaaaattgatttgtaatattattttgtaaattttaaatataaagtaatcaatgtagtatttataaataatattaagcatcaaaatacataatgtaaaattacccacaacagttattgtattttaaaaaatctattatgtgaaattttttgtttttgtttgttttgtttttgtttttcaagtgtttctctgtgtagtcttagctgtcctggaaatctctctgtggagcaggctacagagatccctctgcctctatgccccaggtgctggaattaaagatgtgtacaatcaggcctggcttcaactgaattttctaataaaataagcactctagcagtctgagtcacacttaataataattagtccatgcatgggtacacatatattaaacataaattttcctattcctttggaaaactcttttgataagtataccaaagctgcagattgtctattgagaggttataaatagatattattattttcaggcacttccaccattttttattgaaaatagatccttctctcataaagtacatcctgaacagtctctcctacgctcccctcatcccaacctctcccactgatgcctctgttcttccccagattcactgctctccatttcctcttgagaaaagagcaagcctccaagagacaaggcagatagtccaaagacattattattattattattattattattattattattattattattattattattattattattattattattattattattattattattattattattattattggctattcctgtttggttctcccctaggattgaaccaataatcttcatcctcatcaacatcaatgaaataatgcctcatgatatgtccctgtatccatatatcatgtccaggtttccataccgaggtcagcacatctttgaaatacactggttggtttagttcagcagtttttttcgtagtccagtgtctttccgcagctgtctatccactgtcattggcattaagaaagtttaacgttaataaagcattatgtaatctatgtttggggggtttcgacttaccagcttgcctatggagcatctccttaagtgtcctgttagacctttcaacgactgcttgtcctgtagggttgtgtggtatacctgtgacatgcttaatgttataatatttgaagaactgttccatttttgtggagacatatggaagtatagtgatctagggacaaattagtagagctcctattggaagtagtgagtcagcaaaacatgaaagaaaatttcactataggtaaagaaattgaaagggaggcacagatgtagtaaaagcactggctatgctaatgcaagacaacttttcaggctctgcaaagaaatgtaagacttggaaaattggtcatacaaaaaaaatattgagtgctcactacaaccaatgtgtctgctacacatttttttttgtgttttcttcttcaaaatccatttaagtatcagtgaggactcgtctgtatataggtgatgaaatctcattaagtgtggtgggaaatagcaggttgtatagtttaaaacagaaatgatgtgtactgttgttggcttgaaaaaaattaaatcagaatgcttcatcaaatagccacatatctctcttcccagatcttagctccacttactttgagttggcttaattcaaaaaagcccacggaggcctttttgtgaagatagaataccgtgggctgttcttggtttatggtattctcacaggtaagagtatcaggaaaggatacagattgctgtattcagtttctcctggaaaatagctgagggcaagtgtgttggctcaactgattgactggtcaagaaatactgcttcctttccttgaccttacccacctctagtgtagcagttgtttttttttttctgcttggtttgttccatttagaactatgttctcaaccccattcgtgtgtactgtgtatccacaaatatcaaaattttatttaatttctgttttagcttattaaatataaatatttgtctactgaaagccctttggggtgactataaattgtgctgtaataatcatgatgttgccaggattttatgaggtctgattccaatgctcttttgggtacatatccagtagtatttgctgaagtatatagtgtttccatttaaaaaggtttattttatgcatcttcacaccttttcccataatttgtgaaatgtgttccctataagctatataaaattctcacttttctgatttcttgccagcattatgtgcttttcgaagataggtatttctctctgattttcatgtatcttttcattaggattagcaaagtacaacattttaaaatgtatttgttggttacttatgaggataaaatattgagaacaaaagttatcaaggtgtgtttttagtaagcacatgaagcataattaagaccacaacaccaattttacaataaataaataaataaataaacaaataaaatactatcaaactactatcttagaaacatatgtgcaattgattgatgacatatcatataatagtttagaagtgcccattattcacaagtacaggcattttccatttctgttctttactagcccagacttctgtgattcctcttttaaagtaagcattcagaacaccttgttttggcaaataattttactttttgtttgtaatttacttctgaaagtcttatgaaatgattcatatctctgttagtaatatttagaatgaactatttatttgacaaaggaagatttggaacagggaaaaacaatgaatcccttataagaaatgcatttcctcccaactctgcaagggaaaaggctgctgttgtatttctaatgtattctacaatatctaactaagcaaaaggaggactataaacttggaggcagagaattatatgcacatcatcatggatacagggttctcacgtcattatcacatgaaaaaataacaggggagatcatgactttttaaaaatttttttccaaggaaaagccaaggaaggtagtgataatctttgactaattatccttactaaaaccagtcaaatacttgataaagaggtgtgatgagcaagaaatctgtccattaaaatgagggaaatgaagcaaatgtgataagattgacagaaaaaagtttcttggaatttaaacctcaccagttgttcaaaatatggtgcatacatttgaatgactttgaagtgacttttattgggatgcctagaagtaattgatctacttatcttctttatggataaaatgcatgtatatatatgcatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatggattgagtagatctctctggactatcatgtgtatgaagaaaaaacacttcaaatggaaaatctttaaacacaaataatttgattcaagcatcatggatttatcatcaagcatgtttttccttataatttaattaatttactattgacaagatgcttcagttgcatgagaggtaaaaaccattatttttccaatgaaaataggtgaattagcaaactaatgatttttcatttatgcattttttcttcctaatttttagctgggtggagtatgcttgtataaaatgtggggtccactggcaatgcctgataccttgattagtttctcaaaccctgtgaatttgtaaccctgattcttgtgtttgatctgattctttgttctcaagaaaatgtccagaatccattgtgtattccttgtctgtgcccgaaggagggatgggttataggctggagccctgctaaagcagtcacataaatagaagagtagggtgagtgacagatacacctgatacacaatagttgaggttattcaaattacaaaacaaatatgctttgcaaaaatccctcttagtgttcctatgatattctgacaaactctgttataaatgtttgatttggtttattcattattatatactcatcgaagcatcaggatggattttcctgcattccactgaattacacaactgttctctatgtgggcacataacacacatttttgtgaaagatcgtatctttccatttgctcctaaacttcatattgactgtttcctcccatagaaaacatttcattttgaattcatggttaatgctgcttgttttgtacctgtatcttaaatgacttccttaaatttatttccattatattcccaggttaataataatactttagcttgttttcttttactttgcacaaaactatccaactttcttgttcaaaggaaacatacgcaggggtattcattactccaccaaaatagatatgatattttagtacccataattctccatctgtatgccagatgcttgcagacacgtggcactgctcatattttaaacaaacaaatgtgaaatgtacaagatgggtaaagggcagtgttaatgctttacacatgttcctccattatttggtgctatattaatcttttctgaagtcttaaatatcatttgaaaactgaatgctgcaattctgaaaaacagagatggaaaatgaaccaacttatttagcttctcactattagcctcatatacaacaacttagaaaaacccttcaaggcaaaaaacatgcacttgaactgcaaaaggtcattgaactgtggatacattttgtgtcaagtatcgctttcttcttctctgtgacatactgacttttattgttatttactggaacatggttgtataaaacttaggttttaataaaaaaacaaaatctgaagttgggtatatacacataagtgaatggcacttaaaatcatgaagagtagactcagttgcatctttcttaacctgtccctttgttctgtttgaatgtggaccatctatagtcttctttgtagatgtgcactggtaatcaggcagatttgtagagaaagatttctttatcctatttgtgaagttcagctttgttaaatgttaatctgtttgatttatttactatatggagtgaatcctatttaaataaaaaatgtggaatctctgacccattatttttgttttctatataattctgcttggttatctgcttttcctaaatatataaataaattgtcttgatttgattgctgattcattgaatctttagtagtttcacgctattttgacacataatgtcagtattttaccctagacagcaaaaggcaatattttatggataacacattctcatttcttttctttcataaaattttaccttaaaacatttttctcaaaacccaaaatttaatacaattaatatttttcttcctctttgtttgacattcaggaataaaaatgtggaacacagagacttgtctttcttcctggacaagactgagccaggcaaatattcaagttcaaagtacagaatttagagacagaaaatttaatttccccccatcacatacaaatatcacacacacacacacacacacacacacacacacacacacacacacacacactccccacacaccatatagagggcttttaaacacatacatccatatatatgtaagaaaatataaagtaactatgaatttctgtttaaaataatgataagtggctatggtattttacatgacagagattttctttaatatttatacaattctatcattaggcatgcattaaaatgtggaaaaacaggaaaattgtgtaaggatgtttgaacatagtttactacagctaacacagcaattaaatttgttctatttggaataatgttcctttggaaattcatatgcatttttttttgtttcttgagattgtcaaacatatacaataaaacataatcatttcccctcctctttctgtcttctaatccccacaataatctcctccaacatgatcctctcccaacccaatgactttttgcttgcttgtttgttttgtttgatagcctactaagtctaaatagggttagaaatgtgtgtatgactatgaggcaagctactgaagcattggaagcctattactgatcataccttccacaaataatgattcttcctcagctgctctgtactgccaaaataccattcttaagaagtggggcctggagagtaactccccatctatgctagaattttggctggcttgttctgtgtaggtcttgggcaattaaagaaagcagctattggttcattattacgatagtcactaagattcatggaatagcatttccctggattctgtcacaacttcctgctcttacattctttctgcctctggttccaaaatgtttgtttgttttgtttttgtttcactatgggtgagagtttagagggcaataatgccccctgtttgtttttaatgtacatatcaggcattccaaagtacaatgttaggtcctagagaaggtgatatcattgattattataaacaactaaatatcactcagagaaagccaggaatgatagtagatttcctgtgatctcagaatgtaagagttgtcggcaaaaagatcaatatccagtgtcactctcagctgcacagcaaatttgaggccagcctaggccccgaaaaaaaacaaacaataactcatatagaatccactcaatatggaaaattcatgcttttaaatgtatgtagagccaggtgttggtggcacaggcctttaatcccagcactctggaggtagacacagttggagtttgaatccagcttggtctacagggtgagttcaagggcaggctccaaagcaatacggagaaaccctgtcttgaaaaacaaaacaaaccaaaacaaaacaaaaatttacctggccattattctccttgagtttggatacagtgcatattattctaattttcatttgttactaggcacatacacaaaaatttatccttgcttttgtttatgagtagagaaaatttgtaattatggtaccatgatcatagaacatgtcttcccaattccaaaatcactagaattagaggcttatgtcattcactcttcctaatgaatgttgcatgcttagctctgcagtttttaacagttgcacaataaacgtttcattttcacagtaataaacacaatcggggcatcttgttatacctaagttgaaaaatagaaattaaaaattctgttatctctgtccctatagcatctttgaaactcttcacagtattaaactgtcagtgatttcttttaaaaattttatctaccagtacaagttacaacatgaaatcatgttaaaaacaaataataactaaaagttgaagatcaaatgtaaattttgaaagaattaaaagcgtagaaataaaaattcaaaatatcttttccttaccaggagatgtggattacttatcatccttttctatggttgatatccgataggttaagcatattaatttgctagttttatggaatggtatctggctaatgaaaacacacagatgcttttgaaagggtagaaacttataagagccttgtcccagatctccagagacagaaagaaccctttctttatttccacagaatgaggttggacagagcatgtaagccagttcacattcatatccatgaagtctgagtgactataaggaagatggtagggaggcattgtaaatagcatacacagttaccagtgtttgcttaaaagccaaaagcacacagaaataccatctgaagagaaacatgaggttaatagacttattcccaaagaaagcacgaactgccttctcccagaagtagtaaatggattgaacccatctgaacatcagtttttctagcacctctttgaacttctaaatatctcaaacattcaagtcctctcattcctttacttctttattttcattttttaagtttacagaaatactgttgaaatggatggaaaatatataatacatagtcacacagcagatactcaataataggactgagatttagtttaaatctttgtatttatggtttcaaatgggtttttaatgcatcaatatagagcatctatttaaatattacattgaggacatagatcatcagaaagcaattaaatttgttctaggaacaaaattaatgtaaaggtcacagatttaagttctccatgaaactatcattgtgaatggatatattttttctacctattctttccataattgtaattttccaagctctgatttgcacgagaaaaattatgctctactctttggaacacttttgatgtgaacactattttgctgttgtttctgagcctgtacttgttataaatatgacaaattcatattattctagccaaagagtcatactttaaattattcttcacacattttaatgatgttctgtattgttcttaatgaaggtcagacctgtgagataatatgctattattggttgaattgtagctatttgtatgcattatacatttgacaagaatacagcttctgaagaagacgttcatttacataggaaatgcttttctgtcagcaaaccaaagcatgccctcatccaaatatagaaaagtgttggtggattcatagttttattccataaagaaaaaaatacatttattttctttgatgcttggaggatgaagacaaaaggccatgttgtatttattttatttctctgctctttttacttgatctgttgtttctttgtttcatttgtgtgtacaaatatttggtagtgtttagttattgatctgattactcacttaccaaggacaccatacctggcattcagtgttttcccattgaagtcttgcagaaatatcaaagaaagccttgacatgcattaattgtgaggaaacagaggactatagtctggttttaaatgaaaaaaattgcaggataaattaaacataccccactaagggaaccatcagctggactcactttgtgagtatggatacaccctagttcctgccccagaatgaaaagatacgtaggggaaactgattggtctttggaccagttcaaaataaagtcatgtgaaagtatgttcatagttttcagacttgttattctttctttgttttcctgtcacttttggtacaacatgaaggaagatgctttggattatacttcactttgttttttcctaagtcctagagcaaaggggtgtttttagtctcttagattgtacatataggaaatctcattatggaatgatttcctataaatgtaatcaatacaaaaagcaaatctgtaaaggcaacattaaaattcttcaaagttaaaattgatatgaattattgattttgttttcttttctttttatttaaagcctgggaaatatccaaaatcagtgtggaatttcacaatgaattccctttgactaagtgcaggttcctgaggctcttcttaagttttgttcaatactaatagatttctctcatgaaataaaatatgttgtttacttgactcattttgattctcaaaatgaacttcatttatttatctctgctcttacagctcatagaaaggacagatggtttcttttaacttcttttcataatgtccaatgaaactaggtaatcatttcctacctgatccatgattgatggtaccaatttctttacatctttaaaatgaatttttaaaatgcttaaggggaaatactaccaaaaatgcatattgaatggtatatggggaaatcaacatttagaataatagtttaaatctttattcatctcgtaagtgtacatctttgcagccctgggggacattatggtcatcactactgcagttcacccaggagctatgactgaatctgaagtgtttctcacatgaatgtggtaatgcatgcctgtatttcctcactcaagggaatgaaacacatatgaggacaactacagtatctgtctcaactacagagacagatactgaagaaaaactaaaacctaagaatttgtaataaaaattataaaaggaataatgacacatttgttcttttggtaaatgaaaacaaattttaaatcattcctccttcatttattgtgtgtgtgtgtgtgtgtgtgtgtgtgtgtgtgtgtgtgtgtgtgtgatctatctatctatctatctatctatctatctggagagagagagagagagagagagagagagagagtccatgtctgtgtgcatactggaccacagtacacatgagtggaagttagcaagtacttgagtgtttggtctttttcttctatgtcagccgaagaattaaattcaggttgtcaggtttggcagtaagaatctttacctgctgatctcattagcccttcattttggtgaagtgtcatataccccttaatttggacatactgaattatcttataaaaataattcagttaaatataaaacaattaaggagagagaggagagacacacagacacacagatacacacacacacacacacagagagagagagagagaaagagagagagagagagagagagagagagagacagacagacagacagacagacagacagagacagacagacagagattacagaggtgtaacatattaggtacttgtttttcacttcttttgcctcagacctgagatccctcagtgctgagcaaggaagagtaaaatgaccgaataaaggaaagaccaaaatttgaaatacctttcgattgtggttttgggatagccttgaaagaattagtgagtgatacacagtcatcatctaatctgtgaatcttatgagctccatataggaaactgaaacaaaacacagatggctattgaaatatccagggcaacttaattttttcttgacttatgaacagggacaatgtggcatcatgagataccaagaatgttgagattgtcttcatcttaacatgatcagtactccctgaaaagtttgagatcaagcatcaaacgtgcttgttgccatttctcacaagaaagccacacctgtaagtatgcatccccgtcaatctgcagtagaatgtgtatgcttacatatattaatactactttctttaggaatcaattcagaacatatcccattattgttctgacatctagcagagatacttaagggataactcttatggttttttattccttatatcaaaatttcaaaacatatatgacagttttaaaatccattctaaatagacagtaaattgaaaggtatgttgaaatagtaaaaatattctatatccaaatgaggtagaaatcacctctgaaagtttaatggcttcatttaaatcttgccaaatctatcatctggacagtgaattaccaggtgcatgcaaagggtattattgacctattcatctagcttctttctctcttgcaattcaaactacaaacaacgtgattctgattgcgcttctgtgtgcagctgtactgagattgattactgcaactcttgtgcccagtatcattgccactggcaggcctggaggtgagagcctttccagtgctttgcagaatatgtctcctagttttatggcgaaaactctttttccatggttgcttatttcatcttgctcctgaatattttatttaaaaaagaacagtagtgtgtgaatgcttttagacttggctagtcaagtgttttctggctgtttattttatagtacagtgggcagtaatgcacttgctggcaataaagaggagtgttttcctttctttatgccatcacttctgtttatatctaagaatagtgaaggatcatagtctctcacattctgttttattaatgatttcatcttataaacacatgtatgtataaatggtggatattaaatatgtatgcagaaggatataggattataacttgaaaactaaagtatttatgatcaaaaatacaacttatctttaagagaaaaagcagtgctaactaaatcttcctaagatatatcttgatatttctttgcctttcattgctctgcaggggaaataaatagaggtcacataaaatgtttacatcattttgcttaaactaggttctcggatttcattcctgtccagaatatatttggtatatgatgttgaaattcttcttttcaattccttcattttaatagcaagaaatctgtgaatcctgtaaggtcagaatgaatagtaaatcattgactgaagtaatttaacactgtctttattggctgttaagtattaagtaaatgctagataccatacttttgattttggttaggtatcacaatgtatatctcgattacttaagaacagctgtattgtttcttgttctcaaaagaatgttctaaccaggaataggtcaaatatatttgtttgttaacttgcattacttgcataatgcttagttatataatagatgattgtaacatgaatattataatataaatccagagacagatactgggactcaagctgaagagcagagaagcaaagcagtcaatctgccagtgatctcttacctctacaagggctggggaaatcctaacctcaatttagctggtgactaatcacctaagactgaaagtccaatactgaatcctgcatgagaccctgggctccttcttatatacctctttagtggtgggagtaaaagtctgagttctgtttccctttagactgattcataatcatatagctctgggtggccttgaactcacagagatacatctacctctgtttcctgagtcctgatattaaaggtgtgtgccaacattacctggcctttaaggctgtggctagctttgagtctgatctccaggccagctttttttagatcctaaacaatatatcactatagatgatgtatatcatctactgcctttttatagtctatctatctatctatctatctatctatctatctatctatctatctatctatctatctgtctatctaccacctattgatctatcatctatgcctattattgttgattaactttaaaaacgagtgagaaattgtcattatatgtagtaaagaattgatagtttcaggacaattctgaattctagttttatggagatgcttattactttaagtataaattttcattcttttacttttttgaagatttatcaattttatgtagtattctgcctgcatgtatgcctgcaggccagaagagggcatcagatttcattacagatgattgtgaatcaccatatcttgctgggaattgaacttaggacctctggaagaggagtcagtgctcttgtcctctgggccatctctgcagccctgaactttcattcttttagatgaagtctagatggaaaaaacaaaaacaaaattatgaggcctgaaacaaacaatttactagtgatatacatagagtaataatgacaaaaccagtgatattttcatcttggctcttagcctgcaaatataaaattgcaaaaacaggcaacacttccttgcaatcatagagcacacaacatcttcaaggtgccattcatcacctgactgtttccatgtggagttgaagctacaccatttaaaggccactctacactttatttcatgactactgatcatatgaggatcagtctttggtgaaactgaccctatgggtgagaaatatcttcacagtcttagtccactggaagaggttgatttattttttcatacactactttatctccagttattcagctgtcgtgcttcagagtcttgatcacactgccctgccattcaccagagtttcccagtcagatcactatctctcgctctgcccattcagagaagaggattagggcattcaactgtgtgaagcttagccaacagagaatgattctcttcaccactgttcttcctctcactagagccacttccaaatgaagtttcaggcctagaatcatgcacttgggtggtacatatctaccactactatttttaatgagatatgaatgcttttttcttacctcagatttctggttctgaggattccccatgaggctatgttctggctaaagaatatcttgaaactgaaaaaagagtaaaggcacatgagttacttcctcacaaagcttacatgtacctccaggacattctgcaacttgatctcaagtctcatttgaagatggatgtaaaccatatagccaattttgacatgagcataaattgttaatggtgacttagtgtttcaagggtctaaactgaaatgtttggtctctgttgaattctgggtcttcaaggggatattcatactattcctgataaagctcagggaacatagttctggagatgttctttttctgggcatgacagtcatcatagtcttcagctcacagcatctgtggttgcctgtgctgggtttggacaatacttggcctgtccataatcacacattgcagatgaactcaagagaactacatcctctatgatgaattattgattactgatggattgtgtggctagttattgtcttcagttgtgtacctaatcatgcaccaaagcaggttatactttaagttccaaattcatgttcacacacacagctcttgttgactcagtgggtcaaaatataaaacaaaaagataaatatttcagaaaggcatttttagggaaaataagaatagtaaaggtatcacgaacaggaaggggaggtgagagtaatcaggacacacaaacacacatacacacacacacacacacacacacacacacacacacacacacacaaacacacacacacatatgtctctgtgtgtgaattgttcaatgataaattaacttttaatgaaagctacacaaatatttggtaagaagacagaaactgtctcataggattaatactgaaagtttaatagcacagctctgatgctggttgaaaagtgccttctgtgattcacctataaaggactgccatgcacatatgcatttttttgaacataatggcatctatttccagaagcctatccagaaaacaacttttgatgtgattttggttctacagtgactgctttgtttgtatcccactagaaaaaatagcttgttggccttcttggtagtttgataagtagtttagtagtttgatacttaagtgacattgatttcccccaaattctgcaaaaagccaattattattatatttctttcttggtgctaagagtggttagttgaaatcacctgtcctgtgtcttggattacatagatgtgttctagacaactgaactctcagtaatgctgtgaaagtgttaggaatctggatttttgtgagaagtttattctgatgattagtctactgaggtttgtaagtggttggttgcttttactttgtttgtttttgttgtttttttccaggttcagtggtaggaaatcatcaacacatttaatacaatatgaaagggaagagggtggattcttcccagactaagcctgaagatagtgtttgtactatcttgaaatagtcaatgagtgtttagttatagatctttatcgatgaaactactgcacataacttcaggagttccataatgaaagaaatgaacatggtgtgtaggtgggaatgagagctgtgcacatagtcatgcctgacccataacacatatgcagaacagttaatataagcacactgttaagtccatggaaagactgccccctttccaacatcctctgtctcttgagcaggtcacacatgccagctaaatggacacatttaggcaacattcccatatttgtcactccctgaacacacagatttctgctcactctcccagagtggaaataactttcaagatatcatggtgaaaggtggaggatcctattttctctttcttaaaagaataggcttcatttctgggtcaaataactaatgatagtttgtggaatatgtttatttcatttcctcattctagaattgtatcaataaccacactagccatggacatgtatttctttcaaaaatagacaatccagttctttcattctattgaatctcttgtttgagatgacaaattgaaaaaaaaatggtattctgataatatcaacagtcatatcattattaatgtgttcagagtattttagtaacagcatactaaatatcatctaaagcatataaacttttctgatatacttattgatacaatgctataaaatatcaatacaaggacatttgattaacaagacttggattttcttttatcatttgacttaaatttatagggatgcaactcttagccaatatttgaacttcaagcagcaaaaccattttgtaaagttctgagctagtcatgaatatagactttttgtcctcagctactattgttagttaatttaaagccctttcctcgtcattgctaagtgctttagtcagacatgcattctccaaatgagatgtggctttgatggataaactcaattaaagccaaggcattagataagttaagcagggaattggactgatctttaccaatctaccttttaaaaatacaataagtatttcaaaatgaaccagtcataaattatatggaaaatatgtgagtaaaacagattgaaatgagaatcaattactctatgcaaatttctgtagcttagaaagcaacatttgttttcctccttgactgttgtagtttgtatgaacttttattaagtaaaatcagacaactgcctattgtctgtcaccacaataaaaacccacccactttatagtatttaattttgttaagtcagctagagtaattaatgattaaaaatatgagcttgctaataatatgaaaaccttgaaaaatcaagaatatttttgaaattgttgagtattttaagacataacttaatgaatagcttgcttgtgataagccccagtgttttaactatcttctactcatttccttttttaactgttaacttaaatttttcatattctctgcgacctatataagaaattgttctgggtattataggtcttttaaaaaaagatgtaaagagaaacatgtgaagaaaactttaatgacttcaaataatagtcctacacacacacaccccacagagaaagaggcagagacagagagagagcgagagagagagagagagagagagagagagagacatctatccctgaaaggaacatgttgatttaattgcactatttctaatttagaggaaactttgatatcaacatagaattcaattattttgcagtagtgtgaacagagaatatgaattttaaatttttactcagaacaaatatagccaatgagacaatctatagtaattaggaattggattgtgaaacactaataaatcttaatttaaattcaaagcctccaaaaactaacaacttgaatccactatttaatttgtgtgtgggaggtgtggagaatgggtttctctgtttaactatcctggatgtcctggaacttgctttgtagaccaggctggacatgaacgcactgagatctgcctgcctctgcctcccaagtactggttttaaaggtgtgtgccataactgcctggccaggatttaattttcaagtgcaaaatatggacagcaatcaccagccacttcataatgtttggatttctggttacttgagatcaaacacttaataggagattggtcacagtaagttataggcttttcagaattttatgagttactactgtaaggtacttattatcttgtcgtataagagcccttttcaatctatgctctcgttatttttctcattaatgttgtgattggttactttataatttgtattatttttcaattgccttagaggaagctattaagagaaaaaatacgtaaatctatctgaatttcagtgtgtaaatactctttggaaaagtagttgaatatagggctaaagtgaaagctgtattccatatgagcctgaatattttagttctcaatatagagactgaaaacaaacccaagccaaagttaaacatctcaccatgaccagaataaataaaagcacagagtatcagcactgtccatggataaagatggaataatttgagcaactaacaaaactaattattctattaaaatttaaaatattaaacatatttattagtttatgaagacagagataaatgaccaattaactaagtaaatgatagcaaacagattactcatttgagtgttttctcttcacttcttagtctatttttgtagtctttctggtcattacttattttctcataccttaatccactctctaatgccttgggaggaacagggcatttcactattttcagttttcaatacatccttccctaatgatttcagttcttttaaccttggggtcaatcactcttttatgttttaatttcacctgaacatgtgtctctttccaggaatctttgcttttctcaggtctcacaagtccagtggctcctttaccatcttcaggtgaatgactaataggattattaactgtgactgcaatatgtcctaccagtaagatctctcttttataaaatacttattcaagcttttgctaatctgtgacaatgtttttaattcataggctttgtttcttgatataacatcagtaactatacaactcagtccttgatgaggaagatcagaagttcatggtcatcttaactacatggcatgtttaagaacagcacaggctacatgagaccctgtccaaaaactgatgatttcagtttgcttaaaatcatctaaagttgccaggtgttggtggcacatgcctttaatcccagcacttgggaggcagaggcaggcagatctctgtgagttccaggccagcctggtctacaagagccagttccaggacagcctacaaagccacagagaaaccctgtctcgaaaaaccaaaaaaaaaaaatcatctaaagtttctaaactgattttttgggggggagttgttaagaagaacaagaaagtcttagcaagccagcaattctctgaatgagaattttgaattcaaatttcctattacttaatataattacttattagagaggaagacataacattgcttaccaaatgataatcaaattgctataaaagttttctttcactactattctactagcattaatgatttatatttttcacttatttaagtttttaaattgttacttatggaggaatgttgagtcattttctttattaatattaatatttgaaatgtttagttatgggaaaataattcactcattcctcagatttttaattaactagctttaattgctgtttcttcttctcttttcagatgtcttcctactcatttcttttcccttctccttcttctcccttcagccccccttcctattctctatagtgggaaattaccaatatggagtcaggtatttaatacctgaaggaaaagtcttacttacagagtgacctagcaagctggtgtggcagtggtctgtaggcaagcccaaaagtgaaaccgaaagagaaaacccagtcactcgacctcatcctgactgtgccctggcaagcgtggtcaggcatatgtgtagccagcccctaagtaggcatggctacagcttctcctacaattccccttttagtctaaaagaggattaaaacttaacagtgtaaagtatctaaaattaacgatcataaaggtaaaatataagaagatacaacaatctgcttatgtcacatcctaactatctattttaactaaaccctaaagtcatctgaaagaggtgtccaagccttctgaaagaggggtccaagcctgaacacctctttctaatcccaaccataaacaataggaagctttccctaactaggtatatacactatcctaagtgacaacaatggggaaagggggcatagcatcctctaagttactttctattgaaatgggacaatgatagtcatgtggggtcctgtaggaagaaaatattagtatagtgaaagtcttgaatgaattgtaaccagtccatgttagatgggatttacttgattgaagaacttgcttaaaatcctcaacttgattgaagtcagtacccgaacctctggctggagtgtcagttgaaatggagcaagttggatccagtgcagtcgagggggtatggcccattttctttccagggtgtccaggtatttttgttaggtaagtctttattggctgtgtgggactcaaacataaacagcagagaaatgtttgcttgtggatatacacatgctggggaatgtaaccttgagaacataacaattatgagagggtgaacaccttgaaagaaagagccaagaaaagacaaagacagtctccaaatttttcctttattctgtattatatcagttggcttcttaatacaatacagaaacattaaagtttagttaaataatttgtttagattttagaggaggaaagccaaatccatctctaaatctagcattggtttaattcaataggtactaggaaataaagaaaaatagagttctctgagagacagctgtaaagtttataatatggcatgttcctttttttttttgatggttataggtaccttttcttcttaagtatctacccatgtagtgtcctttgccttttggagatgagtttttctgtgaagataaaagcaaaacacttccctttctttggggggtttctatttagtttataatatacatcttagtagaatacctgtcatttgtcctcattgagaggtttttccttttttacttgaatcttgatcaactttgatgttatctagagtttttcttctcctgtagaaactaatgtaaaacccctaccccaatgcaacatatgtcctggtttccatacagaggttagtacatctttgaagtatactggctgatttagtttagcagttttctccgtagtctagtgtctttctgcagctgtttgtcctttctcattggcattaagaaagtttaatgttaataaagcattatgtaacctatgtttgggggggttagtcttccaagcttgtttgttgagcatctccttaagtgttttattagatctctcaactactgtttgtcctgtaggattgggtggtataccggtaacatgctttatgttataatatttgaaaaattgttccaattttgtagagacatatgttggagcattgtcagtttttatttctgtaggtatacccataactgccatcacctctaccaggtgtgtaataacagaatcagctttttcagagttaagaccagtagcccattggaaccctgagaatgtatctattgtatgatgtacatattttaaatttccaaactctgtaaagtgaaagacatccatctgccaaacctcatttatccaaatgcccttgggattacaacctgctggcaatggagtatgattataaaaggaacaagtaagacagtttctcattatcttcttggcttgttgccaagtgatggacaagttcttttttaaacctttgttatttacctgatgtttcttatgaaattctgaggcttctagtacatttccaattaataaccgattaatctcatcattgtcttgtgctagtgggcctggcagacctgtatgggatctgatatgtgtaatgtatataggattacttctgtttctgatagtttcctgtaattgtaaaaacaatgaggttaattttgtattatcaggaacgaattctgtagtctcaatgtgtaacacgactctctctgcatattgggaatcagtaactatattaagaggttctgtaaaatccataagtaccatgaatattgcatataattctctcttctgtacagatgtatatggactttgaactactttacttacctcatctgctttataacctgccttacctgatttgttggcatcagtgtcgaaagtaagaattccagaaatgggagtttgtcttacaatatgtggaagaatccagactgtcttttttatgaatttaattctgtcagttttggggtaattgttgctaattgtccccaaaaagtcagtaagagctatttgctaatattcattatctttccataaggaggaaatttcctcattagttaaagatactatagtttcggctggatattttccagtcagttgaggaagtcttaatttttcctttaaaatcaaattagaaaacttttttatatatgtcttttgctacgcccacggcggtcacgccggtgtagcagaagatgccactaaagtgggctacaaaatcaggaaatgggtagagacgtggttggtggtatgagccagattttggagaactcttagatcatgtccttgggcaatgaccacaatctgaaactgagaatagatcatctataaacaattttgctgttctttttctttctgttgtatgatatggtgatgtaacccccttgccaagttccctgatcccccttgccaagttccctgattgtaacagtatataagcattgcttgagatgaagatggtcagatgattgaagggagtaccagcagaggaagagaagaatctgggaacattgagtcatttcctcgacgattcctgatttctccttgagccttctcccttgttcccctcggtcagtggtctccacgagaggcggtccatggcagtctttaactttctattctgtttatgtggcagaaatatccattccaatatagtgtcttccctctgcatcagaatcccggaagtgtattttctgaatggcaagataaccagaatacagtctaaatcaaggtttatctgatctacatgcgcatccaaaattttgttttctacccattgtaactctttttctgcctcatcagataatattctaggactgtttaggtccttatcacctttaagggccatttttaaatgctttaagtcatgtccttctacaccaataattgtctgtaattgagaaatttcccctaataatttctgaagagaattaagagtttgataccgatctctcctaatttgtaccttttgaggtctgattctctgtaagtctatcttgtaacctaaatagttaatagaatttcctctttgtatcttttctggtgcaatctgtaatccccaacgaggcagaacttccttcaccatttcaaacatacgttccaaagtttccttattagaatctgataaaagaatatcatccatgtaatgataaacaagagattgtggaaatttcttacgaattattcccaaaggttgctgtacaaagtgttgacacaaagtagggctatttagcattccttgtggcaaaactctccactgatgtctcctaactggctgagaattattaagagttggtacagtaaatgcaattttttctctatcattttcctgtaacggtattgtgaaaaaacagtcttttagatcaatgactatgataggccatcctttaggtattaaggaaggtaatggcattccaggttgcagagagcccattggttgaattaccttatttatagctctcaggtctgtcagcattctccacttacctgacttcattacctgatttcttttttattacaaatacaggagaattccaaggactggtagattcctatatatgtccagcatctagctgttcttgtactaacttttctaaagcctctagcttctcagaggtcataggccattgtcctacccaaaatggttcatttgtaagccatttcaatgtcagggctttggtttcctctgaaggtctgtcatttgtacctagtttctgtacagcatggatggttggtaaccgttttccatagggtcttaccagatcttttctattatctaaagattgtacataatttgtttctgacactggaggaatattaatctgagtattcccttgctgtaagagatcacgaccccagagatttatagctatatctgccacgtatggtttcagtatccctttctgtccttccggtccaatgcagaccactgagaacactctgttgaactctagatagagtaccaattcctaaaaattgtacatttgcctctctaagaggccatttttgaggccaagatatttgggtaataatagttacatcctccccagtgtctactaagccagaaataactttattatcaattttcactttcaactgaggccttttatcattaatagaagcttgccaaaatatgtgtttctcattttgttcattcacacttgattattcatcactatgcaaactaccatctagagcagtatcatttttcacaataggcaaagaactatctattggtcctgtgagagattgtcattgctactgggaatgacccgacctttctcgaagtgggggccttcttgaggtccccccggggtttcccgaccttaacgggtttccttgtatgtccctggttgatctacattcattggtccagtgtctgcccttaccacatcttctacacaatccagaaggcagtggccttctgtatgaggcactgttagaattcgtttgtctacaatttctcttagtatatcccattttaccacagttgaaacatctaggttcctggtgccttcatggtcgccaggggaatgctcttcctacccaaggttctggttcatagtagtagtaaactctagtctcttggtacttatgttgacctctgtaaggtgcttctccttgccaagcccttacatcctcatctctagaacttttaatttcctgttgccattttaaacctttggagatggcttctcctacccaagctccagtatctcggacgttatagtcaatgttggctgcatacaaaacccattcttctaatggagctgatctgatctttaaaggcaaaacattcttttgtatattgggtttgcattttcataagctattttatatataattgattgtcttgtttctggatctgttacctgtaattctagtgccctagttaacctttgtaagaagtcctggaactgttttgtaggtccctgttctattctgatataagcttctaggcattctcctggttcatgaactttatcccaggcatttaatgctgctttcctgcataaagacagcatattgtcatcatattcagcctgaacctgtgggtcagcataaataccctgaccaagaagcatatctagaggggcttcaaaaccttcctttatgtcccgaaactaaaggagctttgcctcttcccttactagtgcctttcattggatttggcatgaattctcaagtacagctgctaccaatcattcccaatctgtgggagttatcctgttaaaggttgcccatgaatgtaatatccgttttacgtatgggctatggagaccatatgagacaactgattctttaatattcttaagatccttcagttatataggttgccattcatgagccatctgtccatgatggtgtttcttagaagctggttgttctaccatggtagctgggtacactaatggtgtaccagtaacaaccttagaagaatagtcacgatacctgggtggagtaggtgcctgggattggagtgattctgcttctgaggcatcccaatgatctttaagcctagtaatgatatccttttgaaaagtttcaatctccttaatcgtaaaagattccaagcacattagtgaatctgtaaattgctctaactcctcatctacatgtttttctaggtctttaatatgatcatccttaggcagcatctggatggcatggaaactgtcttctaggtactggattctagatttgaggtcatgatttgctgattttgagtcctcatcagtcgaccgtatggacctatgtaatctgtcagccctgtactgtaaattatcttccaaacattcaaatctagactcaaatctgtgatatgataccttggatccttcaataactgattgaatggcattgtccaattcttcaaccctatcctgggtattttgcaccgttgcatctagttaatgagtaacattgcctatctgagtttctagctggctacannnnnnnnnnnnnnnnnnnnnnnnnnnnnnnnnnnnnnnnnnnnnnnnnnnnnntctaaggcctcagacatggaggatctctctgtgtttatcttatcataaatatgctgcatcttatcagatagctctgtctttagcttattggacacagagccaagcttatcattcaatttctgttccacttgctcctcaattgtggtctgacctaatctgttctctaaaatctcactgcgtaaagctgttatttcctgtaactaggtgctgaggttatacttatccctattcctgagtcctctggctagtaatattatttgtaccagcaagctaaatgccattatggtatataggccagtaactggcagattagcatcctcctcaaacaatgaattcacataataagcaaaaatattaccaattttagcaaatgataaatattctgccataattttacctgatttctactccagatgcagtaactatctttgaccagtaggtggcacaggtgttcagttagtctgtagagtttggcagtggtgggtggcagctgtggagagaggtcataaaagcggctgcgcttatcttagagagtatatggccttgcggctgcaaccactaaatgagatgctttaaggccattgcactgaccctgctgaaagctaagacctactccaactcagttcaagggctggaggcctgcaggtgtggataggcagctgttcgaactggtcctgagcacatggtgataaaaccgtaggaggtctgtgcgagtctccaagctgggagcagctcagtggcaatgggtcggcttggagctgggaacacctgtgaagagagggagctttcccagccaaggcctcaggcccagtgggacccatagcctgtcccaaatgaggtgtaggtttccaatatccagctcctgacaaccagatatagtggggaattaccaataaggagtcaggtagaaatataagggtatttgatagggaaaagccttacttacagagccacctagccagctggcatggcagtggtctgtgtgtaagcccaaaagtgaaaccaaaagagaaaacacagtcactctacgtcacaagcatgatcaggcacacctgtagccagcccctaagtagacatggctacagcttcccctgcaattctcattctttttcttatttctcccatttcttttctcttctcttacctccgtttttcttcttcatttgtactcttcatcattccttctccctaacatatccttctctctcccttaagtaacttctaaatatttccaagactctatgagatttactcaccagttttcatttattgtgtatactattatatacaaaaaagggtaaatttcaaggttccaaccttcttttgacttaataaaaatagttttatagatcatcttctcattaatttcttccattgtttttgcaagaaatggtgctaaaatatatctaggtaattatcatgcttgatttttctttagctattgtcttgaattttggtactttgtgtgcactgttactgtctctttatgttttcttcatcatgttccagattgtggctatttggaactcaactcagaaaataccatctatttgtcctctttgtctgctggtctcagttttcttcatattaagtctattgatatgtcaacctgctaaaaatagctattttgttgttaagatcatagatcttttaaaaagcaggattattcatgtgttgtttattattgactaactttacctatgagagcacaaaagtggaaaaataatgctgcctcgaggtgaggactcaaatatatctgagtaaatggatgagaaaagaactttaaaaagacatcaggtattcttaggcttaccttactactaatatagtaaaattggacggctactccgagaatttattattgaattttgtatattggttgtatcatttaaaatcaaacagaagtatatagataacactcggtgtttatgagcacttgtgttcttgcagaggacctggaagtgattcccagcaaaatacatgcatgcatgcatgcatacatacataaatacatacatacatgtacatatatgcccacatatataagtgtatatatgtgcatgtataggtaggtaaggagaataaacacacacacacacacacacacacacacatatcactacagacatgtggagcctgagcatacttgaaagcaaaactgtattaaacaaaaagaaataaaactatactgatgattaaatcagaaacagtaatttaatagttgaatgtcttctaatcatatctttggggataccattagggaacacagaactattgtgtgtttgttttcttgttttacagattatctaagtgattaaagttatttgatatccattattgccagagaaatagtagatgagtgaaagtgtgtgcgtgattgattgtgcatggtgtgtgcatttgtgcatgaatctgtgtgtgagagaacactaatgaaatggcaaagtaatctctttatatgactttctgaaaaataacaattaaaataaaattaaagtgtaggaaaaatgcaagaatgaaaacaactgcatgtaacaaaaagaaatcagattattaattattatttatttatacttatgtttattctgcattattattatgccagctttgctagaaaaaaaagctacatttcataaagcagtctttctttcagagtggaaaattctgaaatcattctgccaatatttgaaaatcaaggaaatacttgtagtacatatgtattcatatacacacatacacatttacacacactttcttattttaatgagtgcaaatatttgtgttttgtgtaatatattttgtgttccagtgaaattaattaaattaattgtagataatgaagcatatttaaatgactagtaacatgtactccactattatagataataatttataatttattacactttgaccactgtattatataaaatagccacttacctaatttattataaaatttgtttttcaataactctagtagcaataatttctatcaagttgtacaataatgtattctatatacaacagacaaacttatacattccaaaaaaatatataacaatttccaggaaatcttttataattttcaacattttcacttttaacttgatcagaccttttatgtgcatgtgataaaactagtcaccagcattcactacattaaatatctatttccttcttataaagatttttttatcaggttaataactgcatctaaaaattcacgtatttatattttaaaaataaatttgctagataatataagtataattattaaaattattttattttgcttaattacctgtatacatttgtatttatgtgtaggactctccgtgtgtgcacgtgtgtgtatgcattcatgttgtgtacgtttgtgctcgtgcaagtacctgtggaggacacaaaatctgtcagaccctggagctggagttgcaggcaattatgatactttcaagaaaagttctgtgaatcaaaccttctgcaagagcattgtgtgttctttgtttgtttttgttttttccctgtgtagctttgcagcctatcctggaactagctcttgtagaccaggcgggtctccaactcacagagatccactgcttctgtctcccaagtgctggagttaaaggtgtgtgccaccactgcccagcttctcattatgtgttcttaatcactgacccacctctccatccatgtatttataattgttactcacattccttacataaatagttcttacaaattgaatgatcaggtcatacagttttatgttatgatattagtttggtttcacagcacaggtaatatttttttgaaaaattaaaatcgtttaattaagggaaaaacttagaactaagaatagttgaaatgttggcaatagttaatgcatatgtcattctaatatcaactcatagttttcctctttatccccttttgatacagtttgagattttttctttcatttacctatgatcttcctgcctatgtccgttacttcctaattctctgatgctttaaattcaaccagaaaaagtgaggattcttgaggttaaaatgagtaaatataaattggctgcccagaagatcaaagttttgctcagtgtagttaggtaataaaactataaagagaaagtacatatttttgcttgagtaaattgctgatttgtaaaagttattatatatcgacaagaattcatccgtttagaggacattttttttcatcctactttggcaccctaccactttttccaaatgtcacagagtaacttgttgtataattcattaaatgtaatgttcattctttgagtataaattcagagactttccattcttttaattacttgttcaaggtgttcccatgttacaatcttaaaaggaattatgaaagaaatgctttgaaatatgaagaaatccaattatagggcatataaatttacaagcaattaaatttaagtagtttatccctatcatgtcatagatgtaatttcttaaagggttgtgaaagaattagtgataaatgtgttaagtttaagcatttcattaaaatgagaaatgtattcccatttgaagtgcacttatcttttctttatccaaatccttgcactataataatcagaagaccttaaaaatacataacagcactcaaaaacacatccataatttaaattaacataatcagaacatgaattggcaaatattcaattttgcttttaagaattttaattattaactttaacggagtactaaaacttttctatgtgtagagaaaaatccaaaatatttagttttgagttatgtagctgataaactattttataaagccttgtcatttcaatatctattttgcattgttatagaataatatgtaaagtttctagagaaaaatggtttcttgccttgagtttcctcatgatagaaaatataaaccgagtttagttagccttctgagcctcaattttcttgttggaaaatgaaggatttggtctggtgattcagaatctctcctctctctagaaaataagtaaattctattataagctcaattacctcattatctttgatggtccaaagaaactgtgattagcaaatatattgaagttttgcagctgattttagatcaggtctttgattcatcacactgcacagtgtctaaggagaacacaaagaggcttatgacagttagaagaaatgtcgaatcttaaagtcatgcttttaaatatattttcagaatatgatgtgtcagaattccaaacaaagaatatattgatttttcctttatgaagcctctgactaatgtcttctctttcatcagtgcttcctatgagtacttcattctgatagctttaacacaagaatatctctcatccaatattcttgttcgccctaaggctgaaataattaaattaaattagaccacaaatcatttattccagtaagtttgattaaatttcaacatcccttttatccaacttatttttcttgagttaatttgcatttatactaagatggtatggtttttaaatctccaggtattattagaaaaatgggcaaacaaatacaaaactttaagcccaccttcttaaaactagatctatgttttattttttaaatagagaagagtagggcaatatagggatgaaatctcaaaatcaccacagtctcacctctctacattcagtgagctgtgtgaaagttattcttgtaaatgtggcccaccttcagttttcagagagtgaccttctgttccattatctgtctgggtcatttagctatttccataggacctccttgacccaaaattcaatcatatgttacctagttgcaccagtgaaagccttgccaggctacaaaagatggccagttcaaactcatatcctccattagtaagtctcactagtgtaacacttgtagatcccaggaagtttccattacactaggtttccatactgttccctaaagactcccaactgcacatgttcctcctctcaaacacctatattttctcctctctcatttccacttaccaccagtctacccacagaatctgttctatttccccttccaggagatccctactttccacttatagccaaccttttctcataactctggcagagtggattgtaacttgttcatttacttaacagctaatctcaacttacaagtgatcacataccatatttatctttctggctctgggttacttcgctcaggatgattctttgtctagttccatccatttgcctgcaaaattcatcttgtcatttctttaacttctgaggagtactccattgtgtaaaggttccacaatttctttatccattcttctttttggggccatctaagtcgagtaagtttctggatattatgaagaaagctgcaatgaacatgatggagcatatatcctcatggtaggatagagcatcctatggacatatgcctcagagtattatatctgggaattgagatagatcaatgcacaactttctgaggaactgccacattgatttccataatggctatacaagcttgtagtgccaccagcaattgaggagtgttcccttggctctacatctttgccagcatgagctattacttgtgttattgatcttagccaatctaacagatgtaagatgcaatctcaatatatttttgatttgcattttcatgatgactaaggatgctgaacactttttttgagtttctcagacatttgaaaaccgtctattgagaattctctgtttaagatctatactccatttttaattggattcttttgttgtttactagctagtttcttgggttcttttttattttgaatattagaactttatcagatatggagttggtaaaaaccttttcccattctgtaagctggcactttgtttaaatgatgttgttctttgccttacagaagattttcagtttcatgagataccatatgttaattttttatcttagtgcctgtgcaattggttttctgtttccaaaatattcttctataccattgtgttcaaagctatttccaattttctatgtatctctatttcccattttctttgtatctatatttaccattgtctctatttgtattattataattgaagacatacagtttaactagcaccatttgttcaaggtgcttccttttttcagtgtgtaaatctgacttctttattaaaaaaataaggtatctataggtgtgtaaatgtgtacctaggtcttcaattctactgccttgattatcatggctgtttttatgccaacatcatgtggcctttattactatagttctgaaattagggatggtggtattttcagatgttcttttattgtacagaactgttttatctatccagggtttttaatttgtttttccatatgaagttgagagttaactggatgggggaagtccttctgtgtatatgtctttcttattagttgataaataaagcactcttggccaatagggaagcaagttacatgggactaggagagaaggaggattcagggaaatgtaagaaagaaggagggtcaccatttgatccctgggaagagaggatacattccactggcatccttcacaagataagtctttataaaatatatatatattaatggttctggttgatacttaaagaaagagctagaaaataagaaatcctactcattggccagcagcattgtaactaatataaaactctgtgtgttatttgggggccctaatgtggtggtggaactcagagggctgacaaaaatagttatcattacattaaactttcaagtattataaagaattgtgttgggattctgatggggactgtgttgaatctgtaagatggccatgttcagtaggttagtcccatgcatccatgaccaactgatccacgatcattggagattttccatcttctaatatcatcttcaatttctttcttcaaagacttgaatttttaccctataagtaatttattggcttgattagagttactccatgatatattatttgagacaaccttgaagggtgttatttttctagtttctttcttagtccatttatcatttgtacatatgggggctacttatgtttttgagataatcttttatctagtcactttgatgaaaatgtttataagctgtaggaattccctggttgagtttttttggttacttatatatactataatatcatctgcaaataatgcattttgacttctccttttccagttttaatccccttgatctccttcagctgtcttactgctctacctaaaacttcaaatactatcagtaatagatatgcagagaatgaataattttgtcttgttcctgattctagtggacttccttcaaatttctctccaattaatttggtgttgactatttgcttgctgcaggctatagaaagagaaacctggacagccacccaaccataaaaccctccacctacactcagacttgcctgcaagatgggccagagcaatggtggtaaagaatatgtgggagtgaccaaccaattaaagcagtttggtttaaattgaggtcaacatcatgagaggggtcccatgtgctacagtgcctaggatgccagaaaccagcagccgagtggcccagactccttatgtggaaccaaacatgactgaacaaaaaattcaatgaaattatcattaatgattttctgtaacacttatatgttggtggcttgtctagccatcatcagagaggtcctccagcaacagatgggagtggatacacagacccacagccagacaatatttatagagagtctaaattggagatccccatgaggctcctcccttggagatcagggaacccctcagaggacaggggaagactctaggattgaggaaaccaagagaacacaacctgtcaaattaactaagcaatgctcacatgggctcacagataatgaaatggtaagcatgggggctgaatgtttctgtaccaggttctctgtgtatattttatgactgttagcttgttcatcttgtgagactcctaacagtgtgagtgaggggtgtctctaataatttttctgctccccataatacccttttcttcttatggggttgccttgtccagccttgatatgaggacctttgctttgtcttgtgtcttgttttgtctcatgtggttgtcatctctgagaaaactgctcttttctgaagagcagaaagaggaataatggatctggagtatacaggaagtgaggtagaactaggagtagaggacggcagggaaactcttattgagatttatcgtgtgtgtgaaacacacaccgcacacacacacacacaaatatatatatatcaagcaaaattgccagtttttaatactagtgtgttcttttgacatgggaatagagaatctgttcacagtacagaagcctacattttatccaaatgttgaattgtctatgttaatgcaaaaacacttttcttctttatgtttcagataatttattgaatagtttactatatacaaaaattcctaaagactgcaggttaagtagaaaagaagtttatacttgagataagtaaaattatctatcagactttcacagtaaaccaagcaatcctgttatgatttctgcttaacctggtcaaccccaaaattatttacatacaagtaaattaaatggaattagcatgatttacttatgtatttaggcatgcatgtaacaataacagttaaagtgaaagaggccttaaattatagagaaagtaagggtgatacaggggagagatacaggggaaaagaagaggaaatgatgtaattatattttaattacacaacaaagagtacacacacacaagcacgcacacacacacacacacacacacacacacacatatgacacagtaacacagtgaattcagcatgctccatgaaccttttctggaattcttttatataaggactaattttgaagaatatgccctgggaaactaatactgaattgtttcctactaacactgaggtactgcttcctcttattatcatgataataagcatagcagtgatagtgttctcagaatgctatgaaataagcaatgtagagagtaggtattcaataggtgctcagtaaataaaaccaccatcatattgttattagtatgcttctggaatggttatacttatagcaaaatatagccattaacagaattagcttttttttatgtgtagccacagctggcctcaaagtaatgaaccccctgcctcctccttcagcaaatcttgttggcatgcatctccacaaccagaagaattagctttacttataaaaagactttgaaagtgaagtatttatttaatccatgattcaatatagagagactaattgacattttgaaaataaaaacattacctttggtttgggggattaacttaggtactgtataaattatggcctttttctatatggatatttattgcatgttacagtgtaaatatgttacacttctctatggtctgagatgtcagcatatcgtaaaacatttggagcagttatgcttttaccatctatacactggcaactaacagtacggactgttgaatatagcatctgattcaatgctttgtgacagctaactaggcaagctggataccaacagaacaagaaaatagcaagttatttccatagaaagctcataatgaatcccctaagtttcccttttgtgagattggaggtatgttgcaggaattcaagaaataagtactcagaaaatatctggatgtttgtttcagttattaaatattcattttatttagtgacaagttttcccaaacagaaagcattttgctttgtgctttatttaagaaagtctcatttttgtgttctcttgttaacttcttatttttccaacttgatattttctaaccacaaggaacattgaactgaagagtaaattacaaataaatatatgaaatgggcaaaatatacatgtatatgcattctgagatttcacattttgtgtgtctgtgagttcatgtgtatgtgtgtttatgtttatatgtgtgtatcggtgagtggatatgtgtatgcatgcatgtatttgaaaagcctaactagggcagacattttagaaagacatctggcaatatttaataagcttagtcccagcaaaatccctgtgcatagtttcatgggaacataagtgaatgttcattgcagtgtcaacactgattttggtggcaaagatgtggaaacaatctagctgttcatcatcagctgaattcataagtatatggtgatggatacacagggcccagcactgtactgtcagattatttatacagaaaagtcagtgaacacactaaggtactcacaggtaatacaatcatagttaatattatgcattcttcagatgagtgctgacacaattccatacatcagcatcacagatctgaaaatattcaagtgtttaattgtgcttgctaataagcaggtagtggcaggtaccagagataaatgataatttttgcttatgacacatgttcttatgaatatcatatgatatatggaatacctgtggtgaactatatattgtataaataaatgtttagaatatattcatttgtccaggaatttttgctattttaaatatggattctaaatttttggtaagtgaaaacttctgtttttgcttaggggattattgagaatggaaactagactatggtatttattttattgctgcttaattcatatcttttatttctatctctttattgtggagttaaaacaatacttcagagtaacaaaaaacatgataagcctaagagatgagaagtgttttctacagggcaatgaagctaggtaaatgagggatactggaataaagttactaggaatgtcagatttgtgcttttgattttgaagtaaaataatgtacactgagaaaagagagtgtcttctttaaggaaggttttatgtggaagaaaaaatacaagcgccagaagatatagaagaagaatgtaaaatgttgtcttcagcacattgtcaaagtcaatgctatcatggtctcgctctagctatggtggcttgcatcaagaaagcacaaccttgagcctcttcacagtcaattatcaatcagggaggagctcaggagtctatgctgagctattggctacatgcacatatttgaaaaacattgtatttagttatagcctgataagtctgctcagtgtcaagagtcataggttggatccaattaaactcagttacaaaacaaacagaaatttatgaacaaaggaaagagacctgtgaaaaggaagaagaggtaaataggtgggttgaatctcaaagaaggaagtaatgagaatgaaatgcacacatgtatgaagttttaaagaacaaattaaataaaagttataaacaaaagaaacatttttctcattttaaagccacaaattctaagactcaagcagaaatgaagcagatgatttctctaaattaaaggagaccttctagtctatttaatatccttatattttttcttaaattcagaaagctttgagggcatatgaaacctcagaattcttctattttattataggaaatggtagtgaaattggctttgcagaataatagtatttgcttagtcttcagagtccagtaatatggaaatcatagccaacttccttgggcaaagactttgctcatcatccttgttggcacccttctgattcatgccattcttctcagccctgagtaaggccatttgaatgatctcaggtatgggtaattaaatgcagagcagaaatggtctggcagtagctagacaatcatacaacacccccccacacacacacactttttgttttatattgttgtgaaggcatttttctaaccaaaatttgttgaaatcaatatgctgttgtggattagttgaagatgtcttcaattcatttatgctgtggaacattttgtttaaagatgcaaaggtgtgttgcatttgcttaactctgtgaatctgtgatactttgcctaactctgtgaatctgtgatactttgcctgtctaaaatacctgttttctctaataaagagctgaataacaaataggtaggcatgagacaatagttggaactgccaggcagcaagagaaagagaagagagagtagcaagaaagggaggtgaggaggatgccagggcccagctctccatcctcccccaaacagacatggaataagagggaaagaaaagatatacaagaatagagaaaacaaaagttcagtggtcaaagggagagaggataattttagttagtaaactggctagaaacaagccaagctagggttgggcatttataagaaataagtccccatgcgaatacttgggtgctagctggcaggtccccaaagaacaaagattaataaaagtgaactacaatgttctataagcaaaatgcattgggatacacagagaaggtatacacttggcttagaatgtttgttatgctagtgtgtatgctaccagtttcaagagggtacctcagctgaagaagtgcttccataattctggaccatggatatgtatgtatgtgggtcatattcttcattagatatcaaattgggaagtcccagcctactgtgggacgcgccatccttgagcaggtggtcctgggaggaataagaaagcatgttgagcaagtcatgaggagtaagctggtaagcactatatcttaatggctctgcctcagttcctgcctctaggttcctgctgtacctttcctcaatgaggatgagctgtaaactctaagatacctaaaccttcttcttattaagttgctttttgtcagtgtcttatcacagaaacaaagaagtaaatttggggtaattcattgtggaaatttcaaacaggaatcatcatgtaaactttgctgcataaaatctctatagagatggtattagtaattaaatatcaccctaacttctatcagtattcattaatcaaatcatcactcagtatcttaattatgtgattaaaaccaccttctttccatatctttgagctaaaataactatactttgaaagacatttgaaaattttttataattaataaaaattcctctttaattattttcatgtcgagcatccacttgtagatgaattatatttcaaattatggggacatcttcagcagctattgatgtttctgagacatatgtgggatgataccacctcacataaaatgtagcacacggtcatgaaagccttgaattggtatattgaaaagccacttgcataatttcttaagatgtaaaagccacttactagttattcaatactgggaaaaaataataccatcaacaataagttatcttgctgtcagtgggtgataatgtataatgttctgtaggatgtctgtggtgataaagccaaaaatatctttcactatgttcacaagcttcttttacaagtcaaaattcttcaatatttagataaataaaaaatttctgagggttctagaaattatatgtcatagataatcaaagatccactcagatccattcccatagcagccgtatcaaatggcttcttaatgtgtttttttttatttatcaagaaaactcaaatcttgttatggtctgatgaactgactgactttaaatatagaagcctcgtgggtttccccttgaaaagtaaaaagagtgaattcagaaccatatctttcttgaaatccagcccttatgtctaatagctttaaaattagcagggagccccagggagtcattttgcgatgctttcagtgttaaagcatggaaagtcttttgatttgagttttagaaagcttacatcttagtttttatcttaataagaatctaatactttaattttattttaatttgacaaatgtgtaaggctcaagagtgtttctcgaaagcttcttccagaaggcagatctcaaggaaagtgaatttctgcatctgaatccaggcatcccaaaagcactgtttactcccttgtccatcatgggcttctgctgctgtcgctgctttgttactttaaagaacagtattcagttagccctctgcatgccaatatccacatttacagattccaacaaccatagactgaaagtttttcacagtgaagtcattgaacacacacggtgcacacagtgaacttgctatcattccttgaataattcagcatgattgttactggcatggcactgatattgtgctatgtgtaagagagtgtttgggaagatgtacccaggttaaatgcaaatactatgctgctgcattgtgctgtgtatctcaaatggtatagacctgtcttaaagtgttcaggaggagaaactgatttggtaattcaaatgtaagggttgtggaactatccctttttgtgagctaaggaatgacagtgttggttcaggtgaccttactcactcaagaaacccaaacctgtaaatgaactgagctgtttttaatgctccattagagaacatgtattgcatttagattttatttaatttccatgttaaacaatgaagatgaatagtacctaatgggataccatgttatttgtgtactatgaagtcatagacctgaatttaaagtgtcacaaatgatatgttgcttatacattcataacaaagatggttgttttttattattattttcatttcattagtgaggaaaatgaagttatgaaaatttagattaactgggtgagtgcttatagtcatgttgagtctgatttccactcataaaatggaaccagctacgtattcatcccacaactactatgagtttgagagggggcacggcaagggagcagccattgtgtactgaagtcactgtaaatgctagaatacataaaacacagatcagattcagcgttactcagaaattttgttaccttcaaataatgttttttaaagaaaatctgtgctttgtgtcttttgatttacataaaaactaaatgagttatcctttgcttcacatctaatacccacgtaggagtgagtacatactgtgtgtgtctttctgggtcagggttacctcactgaggatggtttttttagttccatccatttgcctgcaaatttcaagatgtcagtgttttgtttttttttttgtttgtttgtttgtttttttgtttcagctgagtagtactccattgtgtaaacgtaccacattttctttatccattcttgggttgaggggcatcgaggttctttcaaggttcttgctattacaaataatgttgctgtgaatagagtctagcaaatgttctggtggtatgagtgtgcatcctttgggtcatgcccaagagtgttatttctgggtcttgaggtagattgattcccaattttctgagaaactgccatgctgatttccaaagtgactgtataagtttgcattcccacaagcaacagaagagttttccccttattcctcataagctgtcatctgtgtttttgatcttagccatactgccaggtgtaagatggtatctcagagttgtttttgagttacatttccctcatggataaggatgttgggcaattccttaagtgtcttctggccatttgagatccctttcttaagaattctgtttaaatctataccccattttaaaaattggattatttgtcattttgatgtctagtttctttagttctttatatattttatagatcatccctttgtcagatatggggtttgtgaagatattttcccattctgtaagctgtccttttgtattgttgaccacgtcctttgccttacagaagttgcttagtttcagtaggtcccatttattaattgttgctctcagtgtctgtgatcctggtgtaatatttaggaagttatttcctgtgccaatgtattcaatgcttcttctcacttccctttctatgagattcagtgtggctggaaaccagcctatagtctacaacctcagagaagctaagtaacaaggaggatcctaagagaggcatacatggatacccctgggaagggagaaatagacaagactcctgagtaaatcaggaacatgtggtgaggggggaaggtggaagggagagaggaggaggggatacagaggggaatatgaggaaatgagaaggaaagaaaggacagagaaggagaacaaggaaaaaataacatgatagagcatcagaatatagttatcctgaaacctggcactaagggaattctcgtgaatttacaaggatgaccccagcaaacactgtaagcaagagtggagagggagcctgaattggccttccactgtaatcagattgatgacttccttattgtcttcacagaatctttaaccagtaactgatatataagcaaatgcagacatccacagctaacactaggccaagctcttggaggccagtcaaagagagggaagagtgataatcgtagcaaaggggtcaggaccaagatgaaagaacccacagaaataggtgaacaaaactagctcattgactctagactgacaactgaggaatttgcatagggcctctgaatttgagtgacagttgtgtggcttgggtagtctatggggcgacttgcagaaggaccaggattcatccctagtgcatgaactagctttttttatcccatttcctatgaagagataccttttcagccaagattggggaaggcatggcttggtcctgcctgaatgtgatgtgacagactttattgactcttcatgggaggcctcaccctcttctgaggagtggatggaggatggggtatgggaaatgaggggtcaggggaaggagggtcaggatggggaactgggtttttatgtaaaataaaaaaagactgttgataaatactaaatgggagatttgatttaaagtccttaagaaagaagaatagcatttaactacaacttctacacaatttgctagaactttagcctatagtactgccttatagagacatttttgatgatgcagttggaattatctatagatgaatatgctttacctggatttcagaggtgggggtttcctgcagctccccagtgaggcgtaatgctatcttagtgaagtacaaactttgcaagtcaaaatgtgctctcattcttttttatttaatatcaaccgcaattaaatgctcaaatcatgaatattaaaaacatctttaaaaagaaatgacttttctaaaatagaataccacttgaatcatactgatgacccaaaatagtctacctttttttctgtaagtggcatttgattgattctcactgacaaataaaaactgccacatgctgatgtgagtaggtgaggagctcggaaacttatgaagaactgactgccattttgctgtctgaagtatctgtaggtaaatattctactagtggaaagatcacatctatcaccttcctcaacctcatccacaacagcaccagagcctacacacactctcagacactcatgataatagtggcaaatacgctcaacacacacacacacacacacacacacacacacacacacacacagtcttagggattaatttagttgtgaagacagatcctgactctggaatctcttataaagaaaatatttaaatgtgctgtcttgcttacagttcagaggttcagtctatgacagcagagagcattgtggcatgcaggtaggtgtggtgctgaagaaatagcctagagtcttacatcttgtgggcaacaggaaatctactgactgtcatactgagcaaagcttgagaaaaaatcctcaaaaattgtgcccacagtaacacaattccaacaatagatagagtctagattaaaggtgtgctctctaacctcaagttctggattaatggcatgtgtcagccattctccaccaacaagaccacactacaaatggagcctctccctatgagcttatgtgtgccaaatacatcaaatacattcaacctagaacatgtatgcctgtacacacacaggaagctgactttggtaatccaaacctggaagagcaagtatatagttcatttctaagactggggtcttgagaacagcaagcatatgttacagtttcattctgaaagttctaaggatttccacccaaaattgtctttatcttcatctgagttggaaggggacagtggtcacagcttcatctcagtcaggaaaattgtgtccactctgattgagaaatagtgattactttgagagtttgcctgggagaattgaatgaaaaccacatattgcttaacattacctaataatctgtagattcacctcaactgggaacaacattacatatgtgctaggcatgggtacccatgacacaaagaaatttgataaatcatatttgatatcatggtttttcaagttattcctgaccaacttttgtactcttatattttccattttaaaagtacttatttatttatcttgtatgtgtatgagcattttgtctgtatatatgaatgcacacaaggtatatgcagtgtccctagaggttacaagagtacattgaattgccagaactgtagataaagatgtttgtgagctatcctacatggtgttgggagtaaaacccatctcctctgcaagagtagcaagagtttaaaaccactgtgcatctctccagactctgattaactttagataattgataccttgcatgaaattttaagaagcaataatttcaaataaggaaatgggccatcactgcacagttttccagagtaaattcttggagaaccaccttcaatcaaggtgttgacagcaaaatagcttatttgctcttctgtgaggcactgtgaaatgtatctgtttgagtttgtaggtgaatgccccacagtggagcaagtgttttaagagtttatcctcagatgttcattcacactgtttgtagatgctacagaacatttaagaggtggggcttagctacagcatttgtgatgtttggtgtgggaccatagtttgtgttatgcagcagtcatttctgccacattaagtccagcctaaccagagctacattacaaagacacagtctcctgctttctgcccatgatgtccagaggcttcaaccctcaagctttctccactgttgtagctgtacctactcaaaccatgagcccaaataaaaacttctcttaagtttcttgtcttgaatttggtcattatgataagaaatgagccagggtaatgttctctgttgtttttttcagaatgtcttttagattcaagatcctcataaagtgtcaaatatatgatttacaaatattttattctattttatagttagacatttcatatatatatatatgatacatatatataagatttctaacaaaaatatgaattcaacatattttttactcttctgaattattatttgtgactcaaaggttttggatgttctatttttctttttaaaaaatgctttggaatatcattcacatttaaaaatacttaaaaaatacctgggtatttttcaactgctctttgtgtcagtctatacagttgagaattgtccattttagcctattaatatggcttttaaccatagattgagtttccaatattaaaaataaaagtggatgagaaccaaataataaaagttcctttctttacttttattatgttgcttagtaacaaatcatgtaaatgactggtaaagaatggaggtgctttgatacctactattgccctgctttaccacttaccagcagacagttnnnnnnnnnnnnnnnnnnnnnnnnnnnnnnnnnnnnnnnnnnnnnnnntgatgatcatggacatccaagatggagaagtaagcaatggagaatggctattactgtttgaaataagctcctctgctttgaacattaagtccttgaccaggttagttaaggcccctgccactaagctatatccttagtttaaaaatgtatctttgagattgagttacctagcttataatggtttcttctagttccatcaattttcgtgccaattgctttttctttctttttttttcctttggtttttcgaggcagggtttctctgtgtagctttggagcctatcctggcactcactctggagaccaggctggccttgaactcacagagatccacctgcttctgcctcccaagtgctgggattaaaggagtgcgccaccaacgcacggctcctgccaatttcaaaatttctttctttctttctttctttcttttgctgagtagtacttcatggtgtaaatatatcacattttctctatccattcttcagttgaggggcatctaggttgcttccaggttctgactattacaaatagtgctgctatgaatattgttgaagagatgtccttgttatatgaatgtgcttctgttgggtatatgcctaagagtggaattgctggatcttgtggtaattgagtcccactttcctggggagtcttcatactgatttccaaagtggctgtacaagttggcactcccaccagcagtggaggactgttcccctttctccacatcctctacacatcctctccagcataaactgtccttgttgtttttgattatagccattctaacaggaataagatggtatctcagagttgttttgatttgcatttcccctatggataagggtgttgaacactttcttatgtgctcatatatggattttagacacagagtaaaggattgtcagcctgcagcccaggctgcaggagaggcagataaacaaggaggaccctaagagagacatggtcccctggagaagtggaaagggacaagatatcctgagcaaattgggagcaagggagaaggggggagggaattaggagaatgagaaggggagaagaggaggggggaggaggacatgagggagcagaaatgctgagtcggggcaagaatagaagaaaacaagaaagaagataccataataatacagggagacattttaggtttacaaagaagttaggcactagggaaaggtctggagatctacaaaaataacaccaaataacaatctaagcaaaaaaggagaggctaccttaaatgccctcccctgataatgagattgatgactgtattatttgccgtcctatagccttcatccagcagctggtggaaatagaagcagacatccacaactaatcactgaacagaactggaatcctgctgcagagaataatgagtggtgaacaaaggggtccagaccgggatggtgaaacccacagaaacagctgacctgaacatcggggagctctt

What is claimed is:
1. A method for stably expressing a protein at a predetermined site in a Chinese Hamster Ovary (CHO) cell genome, wherein the predetermined site in the CHO cell genome for stably expressing the protein is positioned at base of No. 691045 in a CHO cell gene comprising the nucleotide sequence of SEQ ID NO: 11; the method comprises:

identifying the sequence of SEQ ID NO: 10 in a base range of No. 690980-691090 in the CHO cell gene comprising the nucleotide sequence of SEQ ID NO: 11, around the predetermined site by CRISPR/Cas9 technology and position as a target sequence;

transforming the CHO cell with a recombinant donor carrier to obtain a recombine CHO cell;

culturing the recombinant CHO cell, and collecting a supernatant to detect the expression level of the protein, and adapting an adherent recombinant CHO cell to a suspension culture; and culturing the adapted recombinant CHO cell to express the protein.

2. The method according to claim 1, wherein the protein is one having a molecular weight of less than 160 KDa.

3. The method according to claim 1, wherein the protein is one selected from the group consisting of a polypeptide, a functional protein, an antibody, and a fusion protein.

4. The method according to claim 1, wherein the target sequence includes the bases positioned at No. 691068-691090 around the base of No. 691045 in the CHO cell gene comprising the nucleotide sequence of SEQ ID NO: 11, and the target sequence is the nucleotide sequence of SEQ ID NO: 1.

5. The method according to claim 1, wherein the target sequence is the nucleotide sequence of SEQ ID NO:2.

6. The method according to claim 1, wherein the target sequence is the nucleotide sequence of SEQ ID NO:3.

7. The method according to claim 1, wherein the target sequence is the nucleotide sequence of SEQ ID NO:4.

8. The method according to claim 1, wherein the target sequence is the nucleotide sequence of SEQ ID NO:5.

9. The method according to claim 1, wherein the target sequence is the nucleotide sequence of SEQ ID NO:6.

* * * * *